(12) United States Patent
Bentwich et al.

(10) Patent No.: US 7,592,441 B2
(45) Date of Patent: Sep. 22, 2009

(54) LIVER CANCER-RELATED NUCLEIC ACIDS

(75) Inventors: Itzhak Bentwich, Mishgav (IL); Amir Avniel, Moshav Magshimim (IL); Yael Karov, Tel Aviv (IL); Ranit Aharonov, Tel Aviv (IL)

(73) Assignee: Rosetta Genomics Ltd, Rehovot (IL)

( * ) Notice: Subject to any disclaimer, the term of this patent is extended or adjusted under 35 U.S.C. 154(b) by 105 days.

(21) Appl. No.: 11/418,875

(22) Filed: May 4, 2006

(65) Prior Publication Data

US 2007/0259350 A1    Nov. 8, 2007

Related U.S. Application Data

(63) Continuation-in-part of application No. 11/130,645, filed on May 16, 2005.

(60) Provisional application No. 60/665,094, filed on Mar. 25, 2005, provisional application No. 60/522,457, filed on Oct. 4, 2004.

(51) Int. Cl.
C07H 21/04     (2006.01)
C07H 21/02     (2006.01)
A61K 48/00     (2006.01)
C12N 15/63     (2006.01)

(52) U.S. Cl. .................. 536/24.5; 536/23.1; 536/24.31; 536/24.3; 514/44; 435/320.1

(58) Field of Classification Search .................. None
See application file for complete search history.

(56) References Cited

U.S. PATENT DOCUMENTS

2007/0092882 A1*  4/2007  Wang et al. ............. 435/6

FOREIGN PATENT DOCUMENTS

WO    WO 2006/119266 A2 *  11/2006

OTHER PUBLICATIONS

Lagos-Quintana, M., R. Rauhut, W. Lendeckel and T. Tuschl. Identification of novel genes coding for small expressed RNAs. Science, Oct 26, 2001: (294)853-858.
Lagos-Quintana, M., R. Rauhut, A. Yalcin, J. Meyer, W. Lendeckel and T. Tuschl. Identification of tissue-specific microRNAs from mouse. Curr. Biol. Apr. 30, 2002, (12)735-739.
Dostie, J., Z. Mourelatos, M. Yang, A. Sharma and G. Dreyfuss. Numerous microRNPs in neuronal cells containing novel microRNAs. RNA, Feb. 2003, (9)180-186.
Lagos-Quintana, M., R. Rauhut, J. Meyer, A. Borkhardt and T. Tuschl. New microRNAs from mouse and human. RNA, Feb. 2003, (9)175-179.
Lim, L. P., M. E. Glasner, S. Yekta, C. B. Burge and D. P. Bartel. Vertebrate microRNA genes. Science, Mar. 7, 2003, 1540 299.
Grad, Y., J. Aach, G. D. Hayes, B. J. Reinhart, G. M. Church, G. Ruvkun and J. Kim. Computational and experimental identification of C. elegans mIcroRNAs Mol Cell May 2003 1253-1263 11.
Michael, M. Z., O. C. Sm, N. G. Van Holst Pellekaan, G. P. Young and R. J. James. Reduced accumulation of specific microRNAs in colorectal neoplasia. Mol. Cancer Res., Oct. 2003, (1)882-891.
Altuvia, Y., P. Landgraf, G. Lithwick, N. Elefant, S. Pfeffer, A. Aravin, M. J. Brownstein, T. Tuschl and H. Margalit. Clustering and conservation patterns of human microRNAs Nucleic Acids Res May 12, 2005 2697-2706 33.
Bentwich, I., A. Avniel, Y. Karov, R. Aharonov, S. Gilad, O. Barad, A. Barzilai, P. Einat, U. Einav, E. Meiri, E. Sharon, Y. Spector and Z. Bentwich. Identification of hundreds of conserved and nonconserved human microRNAs. Nat. Genet., Jun. 19, 2005.
Fu, H., Y. Tie, C. Xu, Z. Zhang, J. Zhu, Y. Shi, H. Jiang, Z. Sun and X. Zheng. Identification of human fetal liver miRNAs by a novel method. FEBS Lett., Jul. 4, 2005, (579)3849-3854.
Murakami, Y., Yasuda, T., Saigo, K., Urashima, T., Toyoda, H., Okanoue, T., Shimotohno, K. Comprehensive analysis of microRNA expression patterns in hepatocellular carcinoma and non-tumorous tissues. Oncogene. Oct. 25, 2005, pp. 1-9.
Volinia, S., Caliln, G.A., Liu, C., Ambs, S., Cimmino, A., Petrocca, F., Visone, R., Iorio, M., Roldo, C. Ferracin, M. Prueitt, R., Yanaihara, N., Lanza, G., Scarpa, A., Vecchione, A., Negrini, M., Harris C.C., Croce, G.M. A microRNA expression signature of human solid tumors defines cancer gene targets. PNAS, Feb. 14, 2006, 2257-2261, 103.
Lu, J., Getz, G., Miska, E.A., Alvarez-Saavedra, E., Lamb, J., Peck, D., Sweet-Cardero, A., Ebert, B.L., Mak, R.H., Ferrando, A.A., Downing, J.R., Jacks, T., Horvitz, H.R. and Golub, T.R. MicroRNA expression profiles classify human cancers. Nature. Jun. 9, 2005, 834-836, 435.
Yanaihara, N., Caplen, N., Bowman, E., Seike, M., Kumamoto, K., Yi, M., Stephens, R. M., Okamoto, A., Yokota, J., Tanaka, TO, Calin, G. A., Liu, C., Croce, C. M. and Harris, C. C. Unique microRNA molecular profiles in lung cancer diagnosis and prognosis Cancer Cell Mar. 13, 2006 189-198.
Takamizawa, J., Konishi, H., Yanagisawa, J., Tomida, S., Osada, H., Endoh, H., Harano, T., Yatabe, Y., Nagino, M., Nimura, Y., Mitsudomi, T. and Takahashi, T. Reduced expression of the let-7 microRNAs in human lung cancers in association with shortened postoperative survival Advances in Brief Jun. 1, 2004 3753-3756 64.
Hayashita, Y., Osada, H., Tatematsu, Y., Yamada, H., Yanagisawa, K. Tomida, S., Yatabe, Y., Kawahara, K., Sekido, Y. and Takahashi, T. A polycistronic microRNA cluster, miR-17-92, is overexposed in human lung cancers and enhances cell proliferation AACR Journals Nov. 1, 2005 9628-9632 65.

* cited by examiner

*Primary Examiner*—Amy Bowman
(74) *Attorney, Agent, or Firm*—Polsinelli Shughart PC; Teddy C. Scott, Jr.

(57)    ABSTRACT

Described herein are novel polynucleotides associated with liver cancer. The polynucleotides are miRNAs, miRNA precursors, and associated nucleic acids. Methods and compositions are described that can be used for diagnosis, prognosis, and treatment of liver cancer. Also described herein are methods that can be used to identify modulators of the disease-associated polynucleotides. Also described herein are methods and compositions for linear amplification and labeling of a targeted nucleic acid. The amplified targeted molecules may be used in hybridization techniques like Luminex and Microarray analysis.

6 Claims, 1 Drawing Sheet

US 7,592,441 B2

LIVER CANCER-RELATED NUCLEIC ACIDS

CROSS-REFERENCES TO RELATED APPLICATIONS

This application is a continuation-in-part of U.S. patent application Ser. No. 11/130,645, filed May 16, 2005, which claims the benefit of U.S. Provisional Application No. 60/665,094, filed Mar. 25, 2005, and U.S. Provisional Application No. 60/522,457, filed Oct. 4, 2004.

FIELD OF THE INVENTION

The invention relates in general to microRNA molecules as well as various nucleic acid molecules relating thereto or derived therefrom.

BACKGROUND OF THE INVENTION

MicroRNAs (miRNAs) are short RNA oligonucleotides of approximately 22 nucleotides that are involved in gene regulation. MicroRNAs regulate gene expression by targeting mRNAs for cleavage or translational repression. Although miRNAs are present in a wide range of species including *C. elegans, Drosophila* and humans, they have only recently been identified. More importantly, the role of miRNAs in the development and progression of disease has only recently become appreciated. Deregulated miRNA expression is implicated in onset and progression of different diseases including, but not limited to embryonic malformations and cancers.

As a result of their small size, miRNAs have been difficult to identify using standard methodologies. A limited number of miRNAs have been identified by extracting large quantities of RNA. MiRNAs have also been identified that contribute to the presentation of visibly discernable phenotypes. Expression array data shows that miRNAs are expressed in different developmental stages or in different tissues. The restriction of miRNAs to certain tissues or at limited developmental stages indicates that the miRNAs identified to date are likely only a small fraction of the total miRNAs.

Computational approaches have recently been developed to identify the remainder of miRNAs in the genome. Tools such as MiRscan and MiRseeker have identified miRNAs that were later experimentally confirmed. Based on these computational tools, it has been estimated that the human genome contains 200-255 miRNA genes. These estimates are based on an assumption, however, that the miRNAs remaining to be identified will have the same properties as those miRNAs already identified. Based on the fundamental importance of miRNAs in mammalian biology and disease, the art needs to identify unknown miRNAs. The present invention satisfies this need and provides a significant number of miRNAs and uses thereof.

Moreover, because of their potential broad use in treating and diagnosing different diseases, there is a need in the art (yet unmet) to develop methods of identification, isolation and also quantitation of miRNAs. The present invention addresses the need by disclosing efficient and sensitive methods and compositions for isolating and quantitating miRNAs from different samples, including those wherein there is only minimum amount of a starting material available.

SUMMARY OF THE INVENTION

An isolated nucleic acid is provided. The nucleic acid may comprise a sequence of any of SEQ ID NOS: 1-8661, the complement thereof, or a sequence at least 81% identical to 21 contiguous nucleotides thereof. The nucleic acid may be from about 51 to about 250 nucleotides in length. The nucleic acid many comprise a modified base.

A probe comprising the nucleic acid is also provided. A composition comprising the probe is also provided. A biochip comprising the probe is also provided.

A method for detecting a disease-associated nucleic acid is also provided. A biological sample may be provided from which the level of a nucleic acid may be measured. The nucleic acid may comprise a sequence of any of SEQ ID NOS: 1-8661. The nucleic acid may also comprise a sequence at least about 81% identical to about 21 contiguous nucleotides of any of SEQ ID NOS: 1-8661. A level of the nucleic acid higher than that of a control may be indicative of a disease.

A method for identifying compound that modulates expression of a disease-associated miRNA is also provided. A cell is provided that is capable of expressing a nucleic acid comprising a sequence of any of SEQ ID NOS: 1-50. A cell may also be provided that is capable of expressing a nucleic acid comprising a sequence at least about 81% identical to about 21 contiguous nucleotides of any of SEQ ID NOS: 1-50. The cell may be contacted with a candidate modulator. The level of expression of the nucleic acid may then be measured. A difference in the level of the nucleic acid compared to a control identifies the compound as a modulator of expression of the miRNA.

A method of inhibiting expression of a target gene in a cell is also provided. A nucleic acid may be introduced into the cell in an amount sufficient to inhibit expression of the target gene. The target gene may comprise a binding site substantially identical to a binding site referred to in Table 4 or any of SEQ ID NOS: 51-8661. The nucleic acid may comprise a sequence of any of SEQ ID NOS: 1-50 or a variant thereof. The nucleic acid may also comprise a sequence at least about 81% identical to about 21 contiguous nucleotides of any of SEQ ID NOS: 1-50 or a variant thereof. Expression of the target gene may be inhibited in vitro or in vivo.

A method of increasing expression of a target gene in a cell is also provided. A nucleic acid may be introduced into the cell in an amount sufficient to increase expression of the target gene. The target gene may comprise a binding site substantially identical to a binding site referred to in Table 4 or any of SEQ ID NOS: 51-8661. The nucleic acid may comprise a sequence substantially complementary to any SEQ ID NOS: 1-50 or a variant thereof. The nucleic acid may also comprise a sequence substantially complementary to a sequence at least about 81% identical to about 21 contiguous nucleotides of any of SEQ ID NOS: 1-50 or a variant thereof. Expression of the target gene may be increased in vitro or in vivo.

A method of treating a patient is also provided. The patient may suffer from a disorder set forth in Table 7. The patient may be administered a composition comprising a nucleic acid. The nucleic acid may comprise a sequence of any of SEQ ID NOS: 1-50, the complement thereof, or a sequence at least 81% identical to 21 contiguous nucleotides thereof. The nucleic acid may also comprise the sequence of any of SEQ ID NOS: 1-50, the complement thereof, or a sequence at least 63% identical to 81 contiguous nucleotides thereof. The nucleic acid may be from about 51 to about 250 nucleotides in length. The nucleic acid many comprise a modified base.

Also provided is a method of detecting a target nucleic acid. The targeted nucleic acid may be any nucleic acid, such as a miRNA. A nucleic acid comprising a short RNA sequence and a DNA sequence including a T7 RNA promoter sequence, may be ligated to the miRNA molecule. Another oligonucleotide may be annealed to the T7 promoter region to enable RNA polymerase binding to the double strand. Repeated cycles of initiation and product release may then be performed. As a result a linear amplification of the transcript that includes a complementary sequence to the original natural miRNA is achieved.

During the process of transcription, nucleotides that are labeled (e.g., biotinylated) may be incorporated to the transcript, which may be useful in the later detection of the transcript by a variety of assays. In the case of target nucleic acids expressed at low level, such as miRNAs, this method may provide detection of such target nucleic acids in methods such as Luminex. Using LNA (locked nucleic acid) in the probes that are bound to the Luminex microspheres may allow even more specific hybridization and increased signal strength.

BRIEF DESCRIPTION OF SEQUENCE LISTING AND TABLES

Reference is made to the appendix submitted on the two copies of the one compact disc submitted herewith. The compact disc contains the following: SEQ_01.txt (1,843 KB, May 2, 2006), which is the Sequence Listing, and the following tables: Table_01.txt (2 KB, May 2, 2006), Table_02.txt (4 KB, May 2, 2006), Table_03.txt (1 KB, May 2, 2006), Table_04.txt (193 KB, May 2, 2006), Table_05.txt (137 KB, May 2, 2006), Table_06.txt (5 KB, May 2, 2006), Table_07.txt (1 KB, May 2, 2006), Table_08.txt (233 KB, May 2, 2006), Table_09.txt (163 KB, May 2, 2006), Table_10.txt (4 KB, May 2, 2006), Table_11.txt (17 KB, May 2, 2006), the contents of which are incorporated by reference herein.

DETAILED DESCRIPTION

Figure 1:
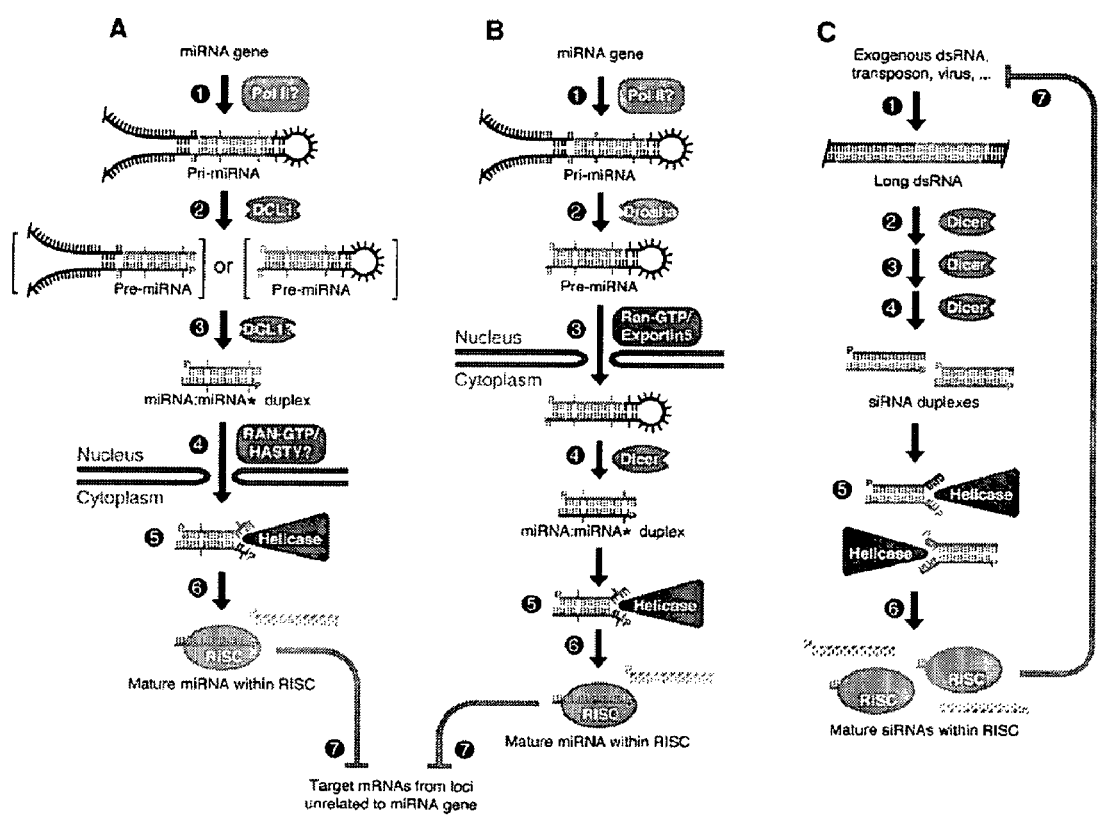
FIG. 1 demonstrates a model of maturation for miRNAs.

Nucleic acids are provided related to miRNAs, precursors thereto, and targets thereof. Such nucleic acids may be useful for diagnostic and prognostic purposes, and also for modifying target gene expression. Also provided are methods and compositions that may be useful, among other things, for diagnostic and prognostic purposes. Other aspects of the invention will become apparent to the skilled artisan by the following description of the invention.

1. Definitions

Before the present compounds, products and compositions and methods are disclosed and described, it is to be understood that the terminology used herein is for the purpose of describing particular embodiments only and is not intended to be limiting. It must be noted that, as used in the specification and the appended claims, the singular forms "a," "an" and "the" include plural referents unless the context clearly dictates otherwise.

a. Animal

"Animal" as used herein may mean fish, amphibians, reptiles, birds, and mammals, such as mice, rats, rabbits, goats, cats, dogs, cows, apes and humans.

b. Attached

"Attached" or "immobilized" as used herein to refer to a probe and a solid support may mean that the binding between the probe and the solid support is sufficient to be stable under conditions of binding, washing, analysis, and removal. The binding may be covalent or non-covalent. Covalent bonds may be formed directly between the probe and the solid support or may be formed by a cross linker or by inclusion of a specific reactive group on either the solid support or the probe or both molecules. Non-covalent binding may be one or more of electrostatic, hydrophilic, and hydrophobic interactions. Included in non-covalent binding is the covalent attachment of a molecule, such as streptavidin, to the support and the non-covalent binding of a biotinylated probe to the streptavidin. Immobilization may also involve a combination of covalent and non-covalent interactions.

c. Biological Sample

"Biological sample" as used herein may mean a sample of biological tissue or fluid that comprises nucleic acids. Such samples include, but are not limited to, tissue or fluid isolated from animals. Biological samples may also include sections of tissues such as biopsy and autopsy samples, frozen sections taken for histologic purposes, blood, plasma, serum, sputum, stool, tears, mucus, hair, and skin. Biological samples also include explants and primary and/or transformed cell cultures derived from animal or patient tissues. A biological sample may be provided by removing a sample of cells from an animal, but can also be accomplished by using previously isolated cells (e.g., isolated by another person, at another time, and/or for another purpose), or by performing the methods described herein in vivo. Archival tissues, such as those having treatment or outcome history, may also be used.

d. Complement

"Complement" or "complementary" as used herein to refer to a nucleic acid may mean Watson-Crick (e.g., A-T/U and C-G) or Hoogsteen base pairing between nucleotides or nucleotide analogs of nucleic acid molecules.

e. Differential Expression

"Differential expression" may mean qualitative or quantitative differences in the temporal and/or cellular gene expression patterns within and among cells and tissue. Thus, a differentially expressed gene may qualitatively have its expression altered, including an activation or inactivation, in, e.g., normal versus disease tissue. Genes may be turned on or turned off in a particular state, relative to another state thus permitting comparison of two or more states. A qualitatively regulated gene may exhibit an expression pattern within a state or cell type which may be detectable by standard techniques. Some genes may be expressed in one state or cell type, but not in both. Alternatively, the difference in expression may be quantitative, e.g., in that expression is modulated, either up-regulated, resulting in an increased amount of transcript, or down-regulated, resulting in a decreased amount of transcript. The degree to which expression differs need only be large enough to quantify via standard characterization techniques such as expression arrays, quantitative reverse transcriptase PCR, northern analysis, and RNase protection.

f. Gene

"Gene" used herein may be a natural (e.g., genomic) or synthetic gene comprising transcriptional and/or translational regulatory sequences and/or a coding region and/or non-translated sequences (e.g., introns, 5'- and 3'-untranslated sequences). The coding region of a gene may be a nucleotide sequence coding for an amino acid sequence or a functional RNA, such as tRNA, rRNA, catalytic RNA, siRNA, miRNA or antisense RNA. A gene may also be an mRNA or cDNA corresponding to the coding regions (e.g., exons and miRNA) optionally comprising 5'- or 3'-untranslated sequences linked thereto. A gene may also be an amplified nucleic acid molecule produced in vitro comprising all or a part of the coding region and/or 5'- or 3'-untranslated sequences linked thereto.

g. Host Cell

"Host cell" used herein may be a naturally occurring cell or a transformed cell that may contain a vector and may support replication of the vector. Host cells may be cultured cells, explants, cells in vivo, and the like. Host cells may be prokaryotic cells such as *E. coli*, or eukaryotic cells such as yeast, insect, amphibian, or mammalian cells, such as CHO and HeLa.

h. Identity

"Identical" or "identity" as used herein in the context of two or more nucleic acids or polypeptide sequences, may mean that the sequences have a specified percentage of residues that are the same over a specified region. The percentage may be calculated by optimally aligning the two sequences, comparing the two sequences over the specified region, determining the number of positions at which the identical residue occurs in both sequences to yield the number of matched positions, dividing the number of matched positions by the total number of positions in the specified region, and multiplying the result by 100 to yield the percentage of sequence identity. In cases where the two sequences are of different lengths or the alignment produces one or more staggered ends and the specified region of comparison includes only a single sequence, the residues of single sequence are included in the denominator but not the numerator of the calculation. When comparing DNA and RNA, thymine (T) and uracil (U) may be considered equivalent. Identity may be performed manually or by using a computer sequence algorithm such as BLAST or BLAST 2.0.

i. Label

"Label" as used herein may mean a composition detectable by spectroscopic, photochemical, biochemical, immunochemical, chemical, or other physical means. For example, useful labels include $^{32}$P, fluorescent dyes, electron-dense reagents, enzymes (e.g., as commonly used in an ELISA), biotin, digoxigenin, or haptens and other entities which can be made detectable. A label may be incorporated into nucleic acids and proteins at any position.

j. Nucleic Acid

"Nucleic acid" or "oligonucleotide" or "polynucleotide" used herein may mean at least two nucleotides covalently linked together. The depiction of a single strand also defines the sequence of the complementary strand. Thus, a nucleic acid also encompasses the complementary strand of a depicted single strand. Many variants of a nucleic acid may be used for the same purpose as a given nucleic acid. Thus, a nucleic acid also encompasses substantially identical nucleic acids and complements thereof. A single strand provides a probe that may hybridize to a target sequence under stringent hybridization conditions. Thus, a nucleic acid also encompasses a probe that hybridizes under stringent hybridization conditions.

Nucleic acids may be single stranded or double stranded, or may contain portions of both double stranded and single stranded sequence. The nucleic acid may be DNA, both genomic and cDNA, RNA, or a hybrid, where the nucleic acid may contain combinations of deoxyribo- and ribo-nucleotides, and combinations of bases including uracil, adenine, thymine, cytosine, guanine, inosine, xanthine hypoxanthine, isocytosine and isoguanine. Nucleic acids may be obtained by chemical synthesis methods or by recombinant methods.

A nucleic acid will generally contain phosphodiester bonds, although nucleic acid analogs may be included that may have at least one different linkage, e.g., phosphoramidate, phosphorothioate, phosphorodithioate, or O-methylphosphoroamidite linkages and peptide nucleic acid backbones and linkages. Other analog nucleic acids include those with positive backbones; non-ionic backbones, and non-ribose backbones, including those described in U.S. Pat. Nos. 5,235,033 and 5,034,506, which are incorporated by reference. Nucleic acids containing one or more non-naturally occurring or modified nucleotides are also included within one definition of nucleic acids. The modified nucleotide analog may be located for example at the 5'-end and/or the 3'-end of the nucleic acid molecule. Representative examples of nucleotide analogs may be selected from sugar- or backbone-modified ribonucleotides. It should be noted, however, that also nucleobase-modified ribonucleotides, i.e. ribonucleotides, containing a non-naturally occurring nucleobase instead of a naturally occurring nucleobase such as uridines or cytidines modified at the 5-position, e.g. 5-(2-amino)propyl uridine, 5-bromo uridine; adenosines and guanosines modified at the 8-position, e.g. 8-bromo guanosine; deaza nucleotides, e.g. 7-deaza-adenosine; O- and N-alkylated nucleotides, e.g. N6-methyl adenosine are suitable. The 2'-OH-group may be replaced by a group selected from H, OR, R, halo, SH, SR, $NH_2$, NHR, $NR_2$ or CN, wherein R is $C_1$-$C_6$ alkyl, alkenyl or alkynyl and halo is F, Cl, Br or I. Modified nucleotides also include nucleotides conjugated with cholesterol through, e.g., a hydroxyprolinol linkage as described in Krutzfeldt et al., Nature (Oct. 30, 2005), Soutschek et al., Nature 432:173-178 (2004), and U.S. Patent Publication No. 20050107325, which are incorporated herein by reference. Modified nucleotides and nucleic acids may also include locked nucleic acids (LNA), as described in U.S. Patent No. 20020115080, which is incorporated herein by reference. Additional modified nucleotides and nucleic acids are described in U.S. Patent Publication Nos. 20050182005, which is incorporated herein by reference. Modifications of the ribose-phosphate backbone may be done for a variety of reasons, e.g., to increase the stability and half-life of such molecules in physiological environments, to enhance diffusion across cell membranes, or as probes on a biochip. Mixtures of naturally occurring nucleic acids and analogs may be made; alternatively, mixtures of different nucleic acid analogs, and mixtures of naturally occurring nucleic acids and analogs may be made.

k. Operably Linked

"Operably linked" used herein may mean that expression of a gene is under the control of a promoter with which it is spatially connected. A promoter may be positioned 5' (upstream) or 3' (downstream) of a gene under its control. The distance between the promoter and a gene may be approximately the same as the distance between that promoter and the gene it controls in the gene from which the promoter is derived. As is known in the art, variation in this distance may be accommodated without loss of promoter function.

l. Probe

"Probe" as used herein may mean an oligonucleotide capable of binding to a target nucleic acid of complementary sequence through one or more types of chemical bonds, usually through complementary base pairing, usually through hydrogen bond formation. Probes may bind target sequences lacking complete complementarity with the probe sequence depending upon the stringency of the hybridization conditions. There may be any number of base pair mismatches which will interfere with hybridization between the target sequence and the single stranded nucleic acids described herein. However, if the number of mutations is so great that no hybridization can occur under even the least stringent of hybridization conditions, the sequence is not a complementary target sequence. A probe may be single stranded or partially single and partially double stranded. The strandedness of the probe is dictated by the structure, composition, and properties of the target sequence. Probes may be directly labeled or indirectly labeled such as with biotin to which a streptavidin complex may later bind.

m. Promoter

"Promoter" as used herein may mean a synthetic or naturally-derived molecule which is capable of conferring, activating or enhancing expression of a nucleic acid in a cell. A promoter may comprise one or more specific transcriptional regulatory sequences to further enhance expression and/or to alter the spatial expression and/or temporal expression of same. A promoter may also comprise distal enhancer or repressor elements, which can be located as much as several thousand base pairs from the start site of transcription. A promoter may be derived from sources including viral, bacterial, fungal, plants, insects, and animals. A promoter may regulate the expression of a gene component constitutively, or differentially with respect to cell, the tissue or organ in which expression occurs or, with respect to the developmental stage at which expression occurs, or in response to external stimuli such as physiological stresses, pathogens, metal ions, or inducing agents. Representative examples of promoters include the bacteriophage T7 promoter, bacteriophage T3 promoter, SP6 promoter, lac operator-promoter, tac promoter, SV40 late promoter, SV40 early promoter, RSV-LTR promoter, CMV IE promoter, SV40 early promoter or SV40 late promoter and the CMV IE promoter.

n. Selectable Marker

"Selectable marker" used herein may mean any gene which confers a phenotype on a host cell in which it is expressed to facilitate the identification and/or selection of cells which are transfected or transformed with a genetic construct. Representative examples of selectable markers include the ampicillin-resistance gene ($Amp^r$), tetracycline-resistance gene ($Tc^r$), bacterial kanamycin-resistance gene ($Kan^r$), zeocin resistance gene, the AURI-C gene which confers resistance to the antibiotic aureobasidin A, phosphinothricin-resistance gene, neomycin phosphotransferase gene (nptII), hygromycin-resistance gene, beta-glucuronidase (GUS) gene, chloramphenicol acetyltransferase (CAT) gene, green fluorescent protein (GFP)-encoding gene and luciferase gene.

o. Stringent Hybridization Conditions

"Stringent hybridization conditions" used herein may mean conditions under which a first nucleic acid sequence (e.g., probe) will hybridize to a second nucleic acid sequence (e.g., target), such as in a complex mixture of nucleic acids. Stringent conditions are sequence-dependent and will be different in different circumstances. Stringent conditions may be selected to be about 5-10° C. lower than the thermal melting point ($T_m$) for the specific sequence at a defined ionic strength pH. The $T_m$ may be the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may be those in which the salt concentration is less than about 1.0 M sodium ion, such as about 0.01-1.0 M sodium ion concentration (or other salts) at pH 7.0 to 8.3 and the temperature is at least about 30° C. for short probes (e.g., about 10-50 nucleotides) and at least about 60° C. for long probes (e.g., greater than about 50 nucleotides). Stringent conditions may also be achieved with the addition of destabilizing agents such as formamide. For selective or specific hybridization, a positive signal may be at least 2 to 10 times background hybridization. Exemplary stringent hybridization conditions include the following: 50% formamide, 5×SSC, and 1% SDS, incubating at 42° C., or, 5×SSC, 1% SDS, incubating at 65° C., with wash in 0.2×SSC, and 0.1% SDS at 65° C.

p. Substantially Complementary

"Substantially complementary" used herein may mean that a first sequence is at least 60%, 65%, 70%, 75%, 80%, 85%, 90%, 95%, 97%, 98% or 99% identical to the complement of a second sequence over a region of 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100 or more nucleotides, or that the two sequences hybridize under stringent hybridization conditions.

q. Substantially Identical

"Substantially identical" used herein may mean that a first and second sequence are at least 60%, 65%, 70%, 75%, 80%, 85%, 90%, 95%, 97%, 98% or 99% identical over a region of 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100 or more nucleotides or amino acids, or with respect to nucleic acids, if the first sequence is substantially complementary to the complement of the second sequence.

r. Target

"Target" as used herein may mean a polynucleotide that may be bound by one or more probes under stringent hybridization conditions.

s. Terminator

"Terminator" used herein may mean a sequence at the end of a transcriptional unit which signals termination of transcription. A terminator may be a 3'-non-translated DNA sequence containing a polyadenylation signal, which may facilitate the addition of polyadenylate sequences to the 3'-end of a primary transcript. A terminator may be derived from sources including viral, bacterial, fungal, plants, insects, and animals. Representative examples of terminators include the SV40 polyadenylation signal, HSV TK polyadenylation signal, CYC1 terminator, ADH terminator, SPA terminator, nopaline synthase (NOS) gene terminator of *Agrobacterium tumefaciens*, the terminator of the Cauliflower mosaic virus (CaMV) 35S gene, the zein gene terminator from *Zea mays*, the Rubisco small subunit gene (SSU) gene terminator sequences, subclover stunt virus (SCSV) gene sequence terminators, rho-independent *E. coli* terminators, and the lacZ alpha terminator.

t. Variant

"Variant" used herein to refer to a nucleic acid may mean (i) a portion of a referenced nucleotide sequence; (ii) the complement of a referenced nucleotide sequence or portion thereof; (iii) a nucleic acid that is substantially identical to a referenced nucleic acid or the complement thereof; or (iv) a nucleic acid that hybridizes under stringent conditions to the referenced nucleic acid, complement thereof, or a sequences substantially identical thereto.

u. Vector

"Vector" used herein may mean a nucleic acid sequence containing an origin of replication. A vector may be a plasmid, bacteriophage, bacterial artificial chromosome or yeast artificial chromosome. A vector may be a DNA or RNA vector. A vector may be either a self-replicating extrachromosomal vector or a vector which integrates into a host genome.

2. MicroRNA

While not being bound by theory, the current model for the maturation of mammalian miRNAs is shown in FIG. 1. A gene coding for a miRNA may be transcribed leading to production of an miRNA precursor known as the pri-miRNA.

The pri-miRNA may be part of a polycistronic RNA comprising multiple pri-miRNAs. The pri-miRNA may form a hairpin with a stem and loop. As indicated on FIG. 1, the stem may comprise mismatched bases.

The hairpin structure of the pri-miRNA may be recognized by Drosha, which is an RNase III endonuclease. Drosha may recognize terminal loops in the pri-miRNA and cleave approximately two helical turns into the stem to produce a 60-70 nt precursor known as the pre-miRNA. Drosha may cleave the pri-miRNA with a staggered cut typical of RNase III endonucleases yielding a pre-miRNA stem loop with a 5' phosphate and ~2 nucleotide 3' overhang. Approximately one helical turn of the stem (~10 nucleotides) extending beyond the Drosha cleavage site may be essential for efficient processing. The pre-miRNA may then be actively transported from the nucleus to the cytoplasm by Ran-GTP and the export receptor Ex-portin-5.

The pre-miRNA may be recognized by Dicer, which is also an RNase III endonuclease. Dicer may recognize the double-stranded stem of the pre-miRNA. Dicer may also recognize the 5' phosphate and 3' overhang at the base of the stem loop. Dicer may cleave off the terminal loop two helical turns away from the base of the stem loop leaving an additional 5' phosphate and ~2 nucleotide 3' overhang. The resulting siRNA-like duplex, which may comprise mismatches, comprises the mature miRNA and a similar-sized fragment known as the miRNA*. The miRNA and miRNA* may be derived from opposing arms of the pri-miRNA and pre-miRNA. MiRNA* sequences may be found in libraries of cloned miRNAs but typically at lower frequency than the miRNAs.

Although initially present as a double-stranded species with miRNA*, the miRNA may eventually become incorporated as a single-stranded RNA into a ribonucleoprotein complex known as the RNA-induced silencing complex (RISC). Various proteins can form the RISC, which can lead to variability in specificity for miRNA/miRNA* duplexes, binding site of the target gene, activity of miRNA (repress or activate), and which strand of the miRNA/miRNA* duplex is loaded in to the RISC.

When the miRNA strand of the miRNA:miRNA* duplex is loaded into the RISC, the miRNA* may be removed and degraded. The strand of the miRNA:miRNA* duplex that is loaded into the RISC may be the strand whose 5' end is less tightly paired. In cases where both ends of the miRNA:miRNA* have roughly equivalent 5' pairing, both miRNA and miRNA* may have gene silencing activity.

The RISC may identify target nucleic acids based on high levels of complementarity between the miRNA and the mRNA, especially by nucleotides 2-8 of the miRNA. Only one case has been reported in animals where the interaction between the miRNA and its target was along the entire length of the miRNA. This was shown for mir-196 and Hox B8 and it was further shown that mir-196 mediates the cleavage of the Hox B8 mRNA (Yekta et al 2004, Science 304-594). Otherwise, such interactions are known only in plants (Bartel & Bartel 2003, Plant Physiol 132-709).

A number of studies have looked at the base-pairing requirement between miRNA and its mRNA target for achieving efficient inhibition of translation (reviewed by Bartel 2004, Cell 116-281). In mammalian cells, the first 8 nucleotides of the miRNA may be important (Doench & Sharp 2004 GenesDev 2004-504). However, other parts of the microRNA may also participate in mRNA binding. Moreover, sufficient base pairing at the 3' can compensate for insufficient pairing at the 5' (Brennecke et al, 2005 PLoS 3-e85). Computation studies, analyzing miRNA binding on whole genomes have suggested a specific role for bases 2-7 at the 5' of the miRNA in target binding but the role of the first nucleotide, found usually to be "A" was also recognized (Lewis et at 2005 Cell 120-15). Similarly, nucleotides 1-7 or 2-8 were used to identify and validate targets by Krek et al (2005, Nat Genet 37-495).

The target sites in the mRNA may be in the 5' UTR, the 3' UTR or in the coding region. Interestingly, multiple miRNAs may regulate the same mRNA target by recognizing the same or multiple sites. The presence of multiple miRNA binding sites in most genetically identified targets may indicate that the cooperative action of multiple RISCs provides the most efficient translational inhibition.

MiRNAs may direct the RISC to downregulate gene expression by either of two mechanisms: mRNA cleavage or translational repression. The miRNA may specify cleavage of the mRNA if the mRNA has a certain degree of complementarity to the miRNA. When a miRNA guides cleavage, the cut may be between the nucleotides pairing to residues 10 and 11 of the miRNA. Alternatively, the miRNA may repress translation if the miRNA does not have the requisite degree of complementarity to the miRNA. Translational repression may be more prevalent in animals since animals may have a lower degree of complementarity between the miRNA and binding site.

It should be noted that there may be variability in the 5' and 3' ends of any pair of miRNA and miRNA*. This variability may be due to variability in the enzymatic processing of Drosha and Dicer with respect to the site of cleavage. Variability at the 5' and 3' ends of miRNA and miRNA* may also be due to mismatches in the stem structures of the pri-miRNA and pre-miRNA. The mismatches of the stem strands may lead to a population of different hairpin structures. Variability in the stem structures may also lead to variability in the products of cleavage by Drosha and Dicer.

3. Nucleic Acid

Nucleic acids are provided herein. The nucleic acid may comprise the sequence of SEQ ID NOS: 1-8661 or variants thereof. The variant may be a complement of the referenced nucleotide sequence. The variant may also be a nucleotide sequence that is substantially identical to the referenced nucleotide sequence or the complement thereof. The variant may also be a nucleotide sequence that hybridizes under stringent conditions to the referenced nucleotide sequence, complements thereof, or nucleotide sequences substantially identical thereto.

The nucleic acid may have a length of from 10 to 250 nucleotides. The nucleic acid may have a length of at least 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 125, 150, 175, 200 or 250 nucleotides. The nucleic acid may be synthesized or expressed in a cell (in vitro or in vivo) using a synthetic gene described herein. The nucleic acid may be synthesized as a single strand molecule and hybridized to a substantially complementary nucleic acid to form a duplex. The nucleic acid may be introduced to a cell, tissue or organ in a single- or double-stranded form or capable of being expressed by a synthetic gene using methods well known to those skilled in the art, including as described in U.S. Pat. No. 6,506,559 which is incorporated by reference.

a. Pri-MiRNA

The nucleic acid may comprise a sequence of a pri-miRNA or a variant thereof. The pri-miRNA sequence may comprise from 45-250, 55-200, 70-150 or 80-100 nucleotides. The sequence of the pri-miRNA may comprise a pre-miRNA, miRNA and miRNA*, as set forth herein, and variants thereof. The sequence of the pri-miRNA may comprise the sequence of SEQ ID NOS: 1-25, the complement of a target gene binding site referred to in Table 4, or variants thereof.

The pri-miRNA may form a hairpin structure. The hairpin may comprise a first and second nucleic acid sequence that are substantially complementary. The first and second nucleic acid sequence may be from 37-50 nucleotides. The first and second nucleic acid sequence may be separated by a third sequence of from 8-12 nucleotides. The hairpin structure may have a free energy less than −25 Kcal/mole as calculated by the Vienna algorithm with default parameters, as described in Hofacker et al., Monatshefte f. Chemie 125: 167-188 (1994), the contents of which are incorporated herein. The hairpin may comprise a terminal loop of 4-20, 8-12 or 10 nucleotides. The pri-miRNA may comprise at least 19% adenosine nucleotides, at least 16% cytosine nucleotides, at least 23% thymine nucleotides and at least 19% guanine nucleotides.

b. Pre-miRNA

The nucleic acid may also comprise a sequence of a pre-miRNA or a variant thereof. The pre-miRNA sequence may comprise from 45-90, 60-80 or 60-70 nucleotides. The sequence of the pre-miRNA may comprise a miRNA and a miRNA* as set forth herein, The sequence of the pre-miRNA may also be that of a pri-miRNA excluding from 0-160 nucleotides from the 5' and 3' ends of the pri-miRNA. The sequence of the pre-miRNA may comprise the sequence of SEQ ID NOS: 1-25, the complement of a target gene binding site referred to in Table 4, or variants thereof.

c. MiRNA

The nucleic acid may also comprise a sequence of a miRNA (including miRNA*) or a variant thereof. The miRNA sequence may comprise from 13-33, 18-24 or 21-23 nucleotides. The miRNA may also comprise a total of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides. The sequence of the miRNA may be the first 13-33 nucleotides of the pre-miRNA. The sequence of the miRNA may also be the last 13-33 nucleotides of the pre-miRNA. The sequence of the miRNA may comprise the sequence of SEQ ID NOS: 26-50, the complement of a target gene binding site referred to in Table 4, or variants thereof.

d. Anti-miRNA

The nucleic acid may also comprise a sequence of an anti-miRNA that is capable of blocking the activity of a miRNA or miRNA*, such as by binding to the pri-miRNA, pre-miRNA, miRNA or miRNA* (e.g. antisense or RNA silencing), or by binding to the target binding site. The anti-miRNA may comprise a total of 5-100 or 10-60 nucleotides. The anti-miRNA may also comprise a total of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides. The sequence of the anti-miRNA may comprise (a) at least 5 nucleotides that are substantially complementary to the 5' of a miRNA and at least 5-12 nucleotides that are substantially identical to the flanking regions of the target site from the 5' end of the miRNA, for the purposes of binding to a miRNA and repressing its activity; or (b) at least 5-12 nucleotides that are substantially identical to the 3' of a miRNA and at least 5 nucleotide that are substantially complementary to the flanking region of the target site from the 3' end of the miRNA, for the purposes of inhibiting the ability of a miRNA to bind to its target. The sequence of the anti-miRNA may comprise the complement of SEQ ID NOS: 26-50, the complement of a target gene binding site referred to in Table 4, or variants thereof.

e. Binding Site of Target

The nucleic acid may also comprise a sequence of a target miRNA binding site, or a variant thereof. The target site sequence may comprise a total of 5-100 or 10-60 nucleotides. The target site sequence may also comprise a total of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62 or 63 nucleotides. The target site sequence may comprise at least 5 nucleotides of the sequence of SEQ ID NOS: 26-50, or a target gene binding site referred to in Table 4.

4. Synthetic Gene

A synthetic gene is also provided comprising a nucleic acid described herein operably linked to a transcriptional and/or translational regulatory sequence. The synthetic gene may be capable of modifying the expression of a target gene with a binding site for a nucleic acid described herein. Expression of the target gene may be modified in a cell, tissue or organ. The synthetic gene may be synthesized or derived from naturally-occurring genes by standard recombinant techniques. The synthetic gene may also comprise terminators at the 3'-end of the transcriptional unit of the synthetic gene sequence. The synthetic gene may also comprise a selectable marker.

5. Vector

A vector is also provided comprising a nucleic acid described herein, such as a pri-miRNA, pre-miRNA, miRNA, anti-miRNA, target gene binding site, or synthetic gene. The vector may be an expression vector. An expression vector may comprise additional elements. For example, the expression vector may have two replication systems allowing it to be maintained in two organisms, e.g., in one host cell for expression and in a second host cell (e.g., bacteria) for cloning and amplification. For integrating expression vectors, the expression vector may contain at least one sequence homologous to the host cell genome, and preferably two homologous sequences that flank the expression construct. The integrating vector may be directed to a specific locus in the host cell by selecting the appropriate homologous sequence for inclusion in the vector. The vector may also comprise a selectable marker gene to allow the selection of transformed host cells.

6. Host Cell

A host cell is also provided comprising a vector, synthetic gene or nucleic acid described herein. The cell may be a bacterial, fungal, plant, insect or animal cell.

7. Probes

A probe is also provided comprising a nucleic acid described herein. Probes may be used for screening and diagnostic methods, as outlined below. The probe may be attached or immobilized to a solid substrate, such as a biochip.

The probe may have a length of from 8 to 500, 10 to 100 or 20 to 60 nucleotides. The probe may also have a length of at least 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 220, 240, 260, 280 or 300 nucleotides. The probe may further comprise a linker sequence of from 10-60 nucleotides.

8. Biochip

A biochip is also provided. The biochip may comprise a solid substrate comprising an attached probe or plurality of probes described herein. The probes may be capable of hybridizing to a target sequence under stringent hybridization conditions. The probes may be attached at spatially defined address on the substrate. More than one probe per target sequence may be used, with either overlapping probes or probes to different sections of a particular target sequence. The probes may be capable of hybridizing to target sequences associated with a single disorder.

The probes may be attached to the biochip in a wide variety of ways, as will be appreciated by those in the art. The probes may either be synthesized first, with subsequent attachment to the biochip, or may be directly synthesized on the biochip.

The solid substrate may be a material that may be modified to contain discrete individual sites appropriate for the attachment or association of the probes and is amenable to at least one detection method. Representative examples of substrates include glass and modified or functionalized glass, plastics (including acrylics, polystyrene and copolymers of styrene and other materials, polypropylene, polyethylene, polybutylene, polyurethanes, TeflonJ, etc.), polysaccharides, nylon or nitrocellulose, resins, silica or silica-based materials including silicon and modified silicon, carbon, metals, inorganic glasses and plastics. The substrates may allow optical detection without appreciably fluorescing.

The substrate may be planar, although other configurations of substrates may be used as well. For example, probes may be placed on the inside surface of a tube, for flow-through sample analysis to minimize sample volume. Similarly, the substrate may be flexible, such as a flexible foam, including closed cell foams made of particular plastics.

The biochip and the probe may be derivatized with chemical functional groups for subsequent attachment of the two. For example, the biochip may be derivatized with a chemical functional group including, but not limited to, amino groups, carboxyl groups, oxo groups or thiol groups. Using these functional groups, the probes may be attached using functional groups on the probes either directly or indirectly using a linkers. The probes may be attached to the solid support by either the 5' terminus, 3' terminus, or via an internal nucleotide.

The probe may also be attached to the solid support non-covalently. For example, biotinylated oligonucleotides can be made, which may bind to surfaces covalently coated with streptavidin, resulting in attachment. Alternatively, probes may be synthesized on the surface using techniques such as photopolymerization and photolithography.

9. Expression Analysis

A method of identifying a nucleic acid associated with a disease or a pathological condition is also provided. The method comprises measuring a level of the nucleic acid in a sample that is different than the level of a control. Detection may be performed by contacting the sample with a probe or biochip described herein and detecting the amount of hybridization. PCR may be used to amplify nucleic acids in the sample, which may provide higher sensitivity.

The level of the nucleic acid in the sample may also be compared to a control cell (e.g., a normal cell) to determine whether the nucleic acid is differentially expressed (e.g., overexpressed or underexpressed). The ability to identify miRNAs that are differentially expressed in pathological cells compared to a control can provide high-resolution, high-sensitivity datasets which may be used in the areas of diagnostics, prognostics, therapeutics, drug development, pharmacogenetics, biosensor development, and other related areas. An expression profile generated by the current methods may be a "fingerprint" of the state of the sample with respect to a number of miRNAs. While two states may have any particular miRNA similarly expressed, the evaluation of a number of miRNAs simultaneously allows the generation of a gene expression profile that is characteristic of the state of the cell. That is, normal tissue may be distinguished from diseased tissue. By comparing expression profiles of tissue in known different disease states, information regarding which miRNAs are associated in each of these states may be obtained. Then, diagnosis may be performed or confirmed to determine whether a tissue sample has the expression profile of normal or disease tissue. This may provide for molecular diagnosis of related conditions.

The expression level of a disease-associated nucleic acid is information in a number of ways. For example, a differential expression of a disease-associated nucleic acid compared to a control may be used as a diagnostic that a patient suffers from the disease. Expression levels of a disease-associated nucleic acid may also be used to monitor the treatment and disease state of a patient. Furthermore, expression levels of a disease-associated miRNA may allow the screening of drug candidates for altering a particular expression profile or suppressing an expression profile associated with disease.

A target nucleic acid may be detected and levels of the target nucleic acid measured by contacting a sample comprising the target nucleic acid with a biochip comprising an attached probe sufficiently complementary to the target nucleic acid and detecting hybridization to the probe above control levels.

The target nucleic acid may also be detected by immobilizing the nucleic acid to be examined on a solid support such as nylon membranes and hybridizing a labeled probe with the sample. Similarly, the target nucleic may also be detected by immobilizing the labeled probe to a solid support and hybridizing a sample comprising a labeled target nucleic acid. Following washing to remove the non-specific hybridization, the label may be detected.

The target nucleic acid may also be detected in situ by contacting permeabilized cells or tissue samples with a labeled probe to allow hybridization with the target nucleic acid. Following washing to remove the non-specifically bound probe, the label may be detected.

These assays can be direct hybridization assays or can comprise sandwich assays, which include the use of multiple probes, as is generally outlined in U.S. Pat. Nos. 5,681,702; 5,597,909; 5,545,730; 5,594,117; 5,591,584; 5,571,670; 5,580,731; 5,571,670; 5,591,584; 5,624,802; 5,635,352; 5,594,118; 5,359,100; 5,124,246; and 5,681,697, each of which is hereby incorporated by reference.

A variety of hybridization conditions may be used, including high, moderate and low stringency conditions as outlined above. The assays may be performed under stringency conditions which allow hybridization of the probe only to the target. Stringency can be controlled by altering a step parameter that is a thermodynamic variable, including, but not limited to, temperature, formamide concentration, salt concentration, chaotropic salt concentration pH, or organic solvent concentration.

Hybridization reactions may be accomplished in a variety of ways. Components of the reaction may be added simultaneously, or sequentially, in different orders. In addition, the reaction may include a variety of other reagents. These include salts, buffers, neutral proteins, e.g., albumin, detergents, etc. which may be used to facilitate optimal hybridization and detection, and/or reduce non-specific or background interactions. Reagents that otherwise improve the efficiency of the assay, such as protease inhibitors, nuclease inhibitors and anti-microbial agents may also be used as appropriate, depending on the sample preparation methods and purity of the target.

a. Diagnostic

A method of diagnosis is also provided. The method comprises detecting a differential expression level of a disease-associated nucleic acid in a biological sample. The sample may be derived from a patient. Diagnosis of a disease state in a patient may allow for prognosis and selection of therapeutic strategy. Further, the developmental stage of cells may be classified by determining temporarily expressed disease-associated nucleic acids.

In situ hybridization of labeled probes to tissue arrays may be performed. When comparing the fingerprints between an individual and a standard, the skilled artisan can make a diagnosis, a prognosis, or a prediction based on the findings. It is further understood that the genes which indicate the diagnosis may differ from those which indicate the prognosis and molecular profiling of the condition of the cells may lead to distinctions between responsive or refractory conditions or may be predictive of outcomes.

b. Drug Screening

A method of screening therapeutics is also provided. The method comprises contacting a pathological cell capable of expressing a disease related nucleic acid with a candidate therapeutic and evaluating the effect of a drug candidate on the expression profile of the disease associated nucleic acid. Having identified the differentially expressed nucleic acid, a variety of assays may be executed. Test compounds may be screened for the ability to modulate gene expression of the disease associated nucleic acid. Modulation includes both an increase and a decrease in gene expression.

The test compound or drug candidate may be any molecule, e.g., protein, oligopeptide, small organic molecule, polysaccharide, polynucleotide, etc., to be tested for the capacity to directly or indirectly alter the disease phenotype or the expression of the disease associated nucleic acid. Drug candidates encompass numerous chemical classes, such as small organic molecules having a molecular weight of more than 100 and less than about 500, 1,000, 1,500, 2,000 or 2,500 daltons. Candidate compounds may comprise functional groups necessary for structural interaction with proteins, particularly hydrogen bonding, and typically include at least an amine, carbonyl, hydroxyl or carboxyl group, preferably at least two of the functional chemical groups. The candidate agents may comprise cyclical carbon or heterocyclic structures and/or aromatic or polyaromatic structures substituted with one or more of the above functional groups. Candidate agents are also found among biomolecules including peptides, saccharides, fatty acids, steroids, purines, pyrimidines, derivatives, structural analogs or combinations thereof.

Combinatorial libraries of potential modulators may be screened for the ability to bind to the disease associated nucleic acid or to modulate the activity thereof. The combinatorial library may be a collection of diverse chemical compounds generated by either chemical synthesis or biological synthesis by combining a number of chemical building blocks such as reagents. Preparation and screening of combinatorial chemical libraries is well known to those of skill in the art. Such combinatorial chemical libraries include, but are not limited to, peptide libraries encoded peptides, benzodiazepines, diversomers such as hydantoins, benzodiazepines and dipeptide, vinylogous polypeptides, analogous organic syntheses of small compound libraries, oligocarbamates, and/or peptidyl phosphonates, nucleic acid libraries, peptide nucleic acid libraries, antibody libraries, carbohydrate libraries, and small organic molecule libraries.

10. Gene Silencing

A method of reducing expression of a target gene in a cell, tissue or organ is also provided. Expression of the target gene may be reduced by expressing a nucleic acid described herein that comprises a sequence substantially complementary to one or more binding sites of the target mRNA. The nucleic acid may be a miRNA or a variant thereof. The nucleic acid may also be pri-miRNA, pre-miRNA, or a variant thereof, which may be processed to yield a miRNA. The expressed miRNA may hybridize to a substantially complementary binding site on the target mRNA, which may lead to activation of RISC-mediated gene silencing. An example for a study employing over-expression of miRNA is Yekta et al 2004, Science 304-594, which is incorporated herein by reference. One of ordinary skill in the art will recognize that the nucleic acids described herein may also be used to inhibit expression of target genes or inhibit activity of miRNAs using antisense methods well known in the art, as well as RNAi methods described in U.S. Pat. Nos. 6,506,559 and 6,573,099, which are incorporated by reference.

The target of gene silencing may be a protein that causes the silencing of a second protein. By repressing expression of the target gene, expression of the second protein may be increased. Examples for efficient suppression of miRNA expression are the studies by Esau et al 2004 JBC 275-52361; and Cheng et al 2005 Nucleic Acids Res. 33-1290, which is incorporated herein by reference.

11. Gene Enhancement

A method of increasing expression of a target gene in a cell, tissue or organ is also provided. Expression of the target gene may be increased by expressing a nucleic acid described herein that comprises a sequence substantially complementary to a pri-miRNA, pre-miRNA, miRNA or a variant thereof. The nucleic acid may be an anti-miRNA. The anti-miRNA may hybridize with a pri-miRNA, pre-miRNA or miRNA, thereby reducing its gene repression activity. Expression of the target gene may also be increased by expressing a nucleic acid that is substantially complementary to a portion of the binding site in the target gene, such that binding of the nucleic acid to the binding site may prevent miRNA binding.

12. Therapeutic

A method of modulating a disease or disorder associated with developmental dysfunctions is also provided. The disease or disorder may be cancer, such as prostate or liver cancer. In general, the nucleic acid molecules described herein may be used as a modulator of the expression of genes which are at least partially complementary to said nucleic acid. Further, miRNA molecules may act as target for therapeutic screening procedures, e.g. inhibition or activation of miRNA molecules might modulate a cellular differentiation process, e.g. proliferation or apoptosis.

Furthermore, existing miRNA molecules may be used as starting materials for the manufacture of sequence-modified miRNA molecules, in order to modify the target-specificity thereof, e.g. an oncogene, a multidrug-resistance gene or another therapeutic target gene. Further, miRNA molecules can be modified, in order that they are processed and then generated as double-stranded siRNAs which are again directed against therapeutically relevant targets. Furthermore, miRNA molecules may be used for tissue reprogramming procedures, e.g. a differentiated cell line might be transformed by expression of miRNA molecules into a different cell type or a stem cell.

13. Compositions

A pharmaceutical composition is also provided. The composition may comprise a nucleic acid described herein and optionally a pharmaceutically acceptable carrier. The compositions may be used for diagnostic or therapeutic applications. The pharmaceutical composition may be administered by known methods, including wherein a nucleic acid is introduced into a desired target cell in vitro or in vivo. Commonly used gene transfer techniques include calcium phosphate, DEAE-dextran, electroporation, microinjection, viral methods and cationic liposomes.

14. Kits

A kit is also provided comprising a nucleic acid described herein together with any or all of the following: assay reagents, buffers, probes and/or primers, and sterile saline or another pharmaceutically acceptable emulsion and suspension base. In addition, the kits may include instructional materials containing directions (e.g., protocols) for the practice of the methods described herein.

15. Method of Synthesis

A method of synthesizing the reverse-complement of a target nucleic acid is also provided. The reverse complement may be synthesized according to methods outlined in U.S. patent Ser. No. 11/384,049, the contents of which are incorporated herein by reference.

16. Method of Detection

A method of detecting a target nucleic acid in a biological sample is also provided. The target nucleic acid may be detected according to methods outlined in U.S. patent Ser. No. 11/384,049, the contents of which are incorporated herein by reference.

EXAMPLE 1

Prediction of MiRNAs

We surveyed the entire human genome for potential miRNA coding genes using computational approaches similar to those described in U.S. Patent Application Nos. 60/522,459, Ser. No. 10/709,577 and Ser. No. 10/709,572, the contents of which are incorporated herein by reference, for predicting miRNAs. Briefly, non-protein coding regions of the entire human genome were scanned for hairpin structures. The predicted hairpins and potential miRNAs were scored by thermodynamic stability, as well as structural and contextual features. The algorithm was calibrated by using miRNAs in the Sanger Database which had been validated.

Table 1 lists the SEQ ID NO for each predicted hairpin ("HID") from the computational screen. Table 1 also lists the genomic location for each hairpin ("Hairpin Location"). The format for the genomic location is a concatenation of <chr_id><strand><start position>. For example, 19+135460000 refers chromosome 19, +strand, start position 135460000. Chromosomes 23-25 refer to chromosome X, chromosome Y and mitochondrial DNA, respectively. The chromosomal location is based on the hg17 assembly of the human genome by UCSC (http://genome.ucsc.edu), which is based on NCBI Build 35 version 1 (35.1) and was produced by the International Human Genome Sequencing Consortium.

Table 1 also lists whether the hairpin is conserved in evolution ("C"). The hairpins were identified as conserved ("Y") or nonconserved ("N") by using phastCons data. The phastCons data is a measure of evolutionary conservation for each nucleotide in the human genome against the genomes of chimp, mouse, rat, dog, chicken, frog, and zebrafish, based on a phylo-HMM using best-in-genome pair wise alignment for each species based on BlastZ, followed by multiZ alignment of the 8 genomes (Siepel et al, J. Comput. Biol 11, 413-428, 2004 and Schwartz et al., Genome Res. 13, 103-107, 2003). A hairpin is listed as conserved if the average phastCons conservation score over the 7 species in any 15 nucleotide sequence within the hairpin stem is at least 0.9 (Berezikov, E. et al. Phylogenetic Shadowing and Computational Identification of Human microRNA Genes. Cell 120, 21-24, 2005).

Table 1 also lists the genomic type for each hairpin ("T") as either intergenic ("G"), intron ("I") or exon ("E"). Table 1 also lists the SEQ ID NO ("MID") for each predicted miRNA and miRNA*. Table 1 also lists the prediction score grade for each hairpin ("P") on a scale of 0-1 (1 the hairpin is the most reliable), as described in Hofacker et al., Monatshefte f. Chemie 125: 167-188, 1994. If the grade is zero or null, they are transformed to the lower value of PalGrade that its p-value is <0.05. Table 1 also lists the p-value ("Pval") calculated out of background hairpins for the values of each P scores. As shown in Table 1, there are few instances where the Pval is >0.05. In each of these cases, the hairpins are highly conserved or they have been validated (F=Y).

Table 1 also lists whether the miRNAs were validated by expression analysis ("E"); this column was intentionally left blank. Table 1 also lists whether the miRNAs were validated by sequencing ("S") (Y=Yes, N=No). If there was a difference in sequences between the predicted and sequenced miRNAs, the sequenced sequence is predicted. It should be noted that failure to sequence or detect expression of a miRNA does not necessarily mean that a miRNA does not exist. Such undetected miRNAs may be expressed in tissues other than those tested. In addition, such undetected miRNAs may be expressed in the test tissues, but at a difference stage or under different condition than those of the experimental cells.

Table 1 also lists whether the miRNAs were shown to be differentially expressed ("D") (Y=Yes, N=No) in at least one disease, as detailed in Table 2. Table 1 also lists whether the miRNAs were present ("F") (Y=Yes, N=No) in Sanger DB Release 8 (February 2005) (http://nar.oupjournals.org/) as being detected in humans or mice or predicted in humans. As discussed above, the miRNAs listed in the Sanger database are a component of the prediction algorithm and a control for the output.

Table 1 also lists a genetic location cluster ("LC") for those hairpins that are within 5,000 nucleotides of each other. Each miRNA that has the same LC share the same genetic cluster. Table 1 also lists a seed cluster ("SC") to group miRNAs by their seed of 2-7 by an exact match. Each miRNA that has the same SC have the same seed. For a discussion of seed lengths of 5-6 nucleotides being sufficient for miRNA activity, see Lewis et al., Cell, 120; 15-20 (2005).

EXAMPLE 2

Prediction of Target Genes

The predicted miRNAs from the computational screen of Example 1 were then used to predict target genes and their binding sites using two computational approaches similar to those described in U.S. Patent Application Nos. 60/522,459, Ser. No. 10/709,577 and Ser. No. 10/709,572, the contents of which are incorporated herein by reference, for predicting miRNAs.

Table 4 lists the predicted target gene for each miRNA (MID) and its hairpin (HID) from the computational screen. The names of the target genes were taken from NCBI Reference Sequence release 16 (http://www.ncbi.nlm.nih.gov; Pruitt et al., Nucleic Acids Res, 33 (1):D501-D504, 2005; Pruitt et al., Trends Genet., 16(1):44-47, 2000; and Tatusova et al., Bioinformatics, 15(7-8):536-43, 1999). Target genes were identified by having a perfect complementary match of a 7 nucleotide miRNA seed (positions 2-8) that have an "A" after the seed on the UTR and/or an exact match in the nucleotide before the seed (total=8 nucleotides). For a discussion on identifying target genes, see Lewis et al., Cell, 120: 15-20, (2005). For a discussion of the seed being sufficient for binding of a miRNA to a UTR, see Lim Lau et al., (Nature 2005) and Brenneck et al, (PLoS Biol 2005).

Binding sites were then predicted using a filtered target genes dataset by including only those target genes that contained a UTR of a least 30 nucleotides. The binding site screen only considered the longest transcript when there were several transcripts per gene. A total of 16,656 transcripts were included in the dataset. Table 4 lists the SEQ ID NO for the predicted binding sites for each target gene as predicted from each miRNA ("MID"). The sequence of the binding site includes the 20 nucleotides 5' and 3' of the binding site. If the binding site encompasses 2 exons, the sequence includes 20 nucleotides 5' and 3' of the binding site, as the ends are situated on the spliced mRNA.

Table 5 shows the relationship between the miRNAs ("MID")/hairpins ("HID") and diseases by their target genes. The name of diseases are taken from OMIM. For a discussion of the rational for connecting the host gene the hairpin is located upon to disease, see Baskerville and Bartel, RNA, 11: 241-247 (2005) and Rodriguez et al., Genome Res., 14: 1902-1910 (2004). Table 5 shows the number of miRNA target genes ("N") that are related to the disease. Table 5 also shows the total number of genes that are related to the disease ("T"), which is taken from the genes that were predicted to have binding sites for miRNAs. Table 5 also shows the percentage of N out of T ("P") and the p-value of hypergeometric analysis ("Pval"). Table 8 shows the disease codes for the diseases described in Table 5 and Tables 9-11. For a reference of hypergeometric analysis, see Schaum's Outline of Elements of Statistics II: Inferential Statistics.

Table 9 shows the relationship between the target sequences ("Gene Name") and disease ("Disease Code").

Table 10 shows the relationship between the miRNAs ("MID")/hairpins ("HID"), known SNPs and diseases. SNP were identified in the sequence of hairpins. For the miRNAs of these hairpins, all their target genes listed in Table 4 were collected. For these genes, we checked whether they are associates to disease(s) according to OMIM. The numeric code of the relevant diseases for each miRNA according to Table 9 are presented in Table 10. The disease codes are taken from Table 8. If a target gene was not related to a disease in Table 9, SNP data is not presented. Each SNP ("SNP_Id") is identified based on NCBI database dbSNP BUILD 124 based on NCBI Human Genome Build 35.1. The genomic location for each SNP ("SNP_location") is also provided in a formation concatenating "<chr_id>:<start position>". For example, "19: 135460569" means chr19 +strand, start position 135460569. Although the mutations are referred to as SNPs, a number of the mutations cover a few nucleotides (e.g., small insertions, deletions, micro-satellites, etc.) For a discussion on the connection between a SNP and disease, see Swibertus (Blood 1996) and Frittitta (Diabetes 2001).

Table 11 shows the relationship between miRNAs ("MID"), hairpins ("HID"), SNP identification number ("SNP_Id"), SNP location ("SNP_location"), genes and diseases. SNP identification and location are defined as described for Table 10. The SNPs listed are only those that are located in a miRNA target gene known to be associated with a disease in the OMIM database. "Gene" indicates the name of the gene in which the SNP is located.

EXAMPLE 3

Differential Expression of miRNAs

1. Sequencing

To validate the hairpins ("HID"), a number of miRNAs were evaluated by sequencing methods similar to those described in U.S. Patent Application Nos. 60/522,459, Ser. No. 10/709,577 and Ser. No. 10/709,572, the contents of which are incorporated herein by reference. Table 3 shows the hairpins ("HID") that were validated by sequencing a miRNA ("MID") in the indicated tissue ("Tissue"). Numeric codes for the tissues are shown in Table 6.

2. Differential Expression

To confirm the hairpins and miRNAs predicted in Example 1, we detected expression in various tissues (versus controls) using the high-throughput microarrays similar to those described in U.S. Patent Application Nos. 60/522,459, Ser. No. 10/709,577 and Ser. No. 10/709,572, the contents of which are incorporated herein by reference. Microarray images were analyzed using Feature Extraction Software (Version 7.1.1, Agilent).

Differential expression of the miRNAs was then analyzed in various disease tissues using similar methods described above. Table 2 shows the ratio of disease related expression ("R") compared to normal tissues for the indicated diseases. Disease codes for the disease are shown in Table 7. Table 2 also shows the statistical analysis of the normalized signal ("RPval"). The signal of each probe was set as its median intensity. Signal intensities range from background level of 400 to saturating level of 66,000. 2 channels hybridization was performed and Cy3 signals were compared to Cy5 signals, where fluor reversed chip was preformed (normal vs. disease), probe signal was set to be its average signal. Signals were normalized by first performing a logarithmic transformation (log2), followed by adapting a polynomic graph of the second degree. Following normalization, a t-test for each miRNA and disease was performed. P values were estimated based on the occurrences of such or greater signal ratios over duplicated experiments. miRNAs with a p value<0.05 are shown in Table 2. The total number of samples ("N") used for each analysis is also shown in Table 2. The differential expression analysis in Table 2 indicates that the expression of a number of the miRNAs is significantly altered in disease tissue.

SEQUENCE LISTING (8661 sequences)

SEQ ID NO: 1 - RNA, 65 nt, Human
gagcaucuuaccggacagugcuggauuucccagcuugacucuaacacugucugguaacgauguuc

SEQ ID NO: 2 - RNA, 86 nt, Human
gggcgggggcccucgucuuacccagcaguguuugggugcgguugggagucucuaauacugccggguaaugauggaggccccugucc

SEQ ID NO: 3 - RNA, 85 nt, Human
ggcacuugggaauggcaaggaaaccguuaccauuacugaguuuaguaaugguaaugguucucuugcuauacccagaaaacgugcc

SEQ ID NO: 4 - RNA, 60 nt, Human
uaaucucagcuggcaacugugagauguucauacaaucccucacaguggucucugggauua

SEQ ID NO: 5 - RNA, 96 nt, Human
accucucuaacaaggugcagagcuuagcugauuggugaacagugauugguuuccgcuuuguucacaguggcuaaguucugcaccugaagagaaggu

SEQ ID NO: 6 - RNA, 83 nt, Human
ggggcuuucaagucacuagugguuccguuuaguagaugauugugcauuguuucaaaauggugcccuagugacuacaaagcccc

SEQ ID NO: 7 - RNA, 104 nt, Human
gucggccggcccuggguccaucuuccaguacaguguuggauggucuaauugugaagcuccuaacacugucugguaaagauggcucccggguggguucucucggc

SEQ ID NO: 8 - RNA, 87 nt, Human
uccaugugcuucucuuguccuucauuccaccggagucugucucauacccaaccagauuucaguggagugaaguucaggaggcaugga

SEQ ID NO: 9 - RNA, 84 nt, Human
ccuuaaaguacuguagcagcacaucaugguuuacaugcuacagucaagaugcgaaucauuauuugcugcucuagaaauuuaagg

SEQ ID NO: 10 - RNA, 104 nt, Human
ggcuggacagaguugucaugugucugccugucuacacuugcugugcagaacauccgcucaccuguacagcaggcacagacaggcagucacaugacaacccagcc

SEQ ID NO: 11 - RNA, 90 nt, Human
guaccaccuugucggguagcuuaucagacugauguugacuguugaaucucauggcaacaccagucgaugggcugucugacauuuugguau

SEQ ID NO: 12 - RNA, 90 nt, Human
gcccuuuggggugagguaguagguuguauaguuuggggcucugcccugcuaugggauaacuauacaaucuacugucuuuccugaaguggc

SEQ ID NO: 13 - RNA, 83 nt, Human
ggccccgccaacccaguguucagacuaccuguucaggaggcucucaauguguacaguagucugcacauugguuaggcugggcu

SEQ ID NO: 14 - RNA, 81 nt, Human
agugagcgacuguaaacauccucgacuggaagcugugaagccacagaugggcuuucagucggauguuugcagcugccuacu

SEQ ID NO: 15 - RNA, 79 nt, Human
gcuccgucgccccaguguucagacuaccuguucaggacaaugccguuguacaguagucugcacauugguuagacugggc

SEQ ID NO: 16 - RNA, 79 nt, Human
ucucccagccugaggugcagugcugcaucucuggucaguugggagucugagaugaagcacuguagcucaggaagagaga

SEQ ID NO: 17 - RNA, 109 nt, Human
uugugacugcaugcucccagguugagguaguagguuguauaguuuagaauuacaucaagggagauaacuguacagccuccuagcuuuccuugggucuugcacuaaacaa

SEQ ID NO: 18 - RNA, 90 nt, Human
guuuuugaugucgcagauacugcaucaggaacugauuggauaagaaucagucaccaucaguuccuaaugcauugccuucagcaucuaaac

SEQ ID NO: 19 - RNA, 82 nt, Human
gccaguguugagaggcggagacuugggcaauugcuggacgcugcccugggcauugcacuugucucggucugacagugccggc

SEQ ID NO: 20 - RNA, 95 nt, Human
gugccuggccugaggagcagggcuuagcugcuugugagcaggguccacaccaagucguguucacaguggcuaaguuccgccccccaggcccucac

SEQ ID NO: 21 - RNA, 83 nt, Human
guggucucagaaucgggguuuugagggcgagaugaguuuauguuuuauccaacuggcccucaaagucccgcuuuuggggucau

SEQ ID NO: 22 - RNA, 90 nt, Human
ggcuggacagcgggcaacggaaucccaaaagcagcuguugucuccagagcauuccagcugcgcuuggauuucguccccugcucuccugcc

SEQ ID NO: 23 - RNA, 86 nt, Human
accuuguccucacgguccaguuuucccaggaaucccuuagaugcuaagauggggauuccuggaaauacuguucuugaggucauggu

SEQ ID NO: 24 - RNA, 127 nt, Human
cccuggauguucucuucacugugggaugagguaguagguuguauaguuuuagggucacacccaccacugggagauaacuauacaaucuacugucuuuccuaacgugauagaaaagucugcauccagg

SEQ ID NO: 25 - RNA, 89 nt, Human
gcucgggcagccguggccaucuuacugggcagcauuggauggagucaggucucuaauacugccugguaaugaugacggcggagcccugc

SEQ ID NO: 26 - RNA, 22 nt, Human
uaacacugucugguaacgaugu

SEQ ID NO: 27 - RNA, 22 nt, Human
uaauacugccggguaaugaugg

SEQ ID NO: 28 - RNA, 23 nt, Human
aaaccguuaccauuacugaguuu

SEQ ID NO: 29 - RNA, 21 nt, Human
uaaucucagcuggcaacugug

SEQ ID NO: 30 - RNA, 21 nt, Human
uucacaguggcuaaguucugc

SEQ ID NO: 31 - RNA, 23 nt, Human
caagucacuagugguuccguuua

SEQ ID NO: 32 - RNA, 22 nt, Human
uaacacugucugguaaagaugg

SEQ ID NO: 33 - RNA, 22 nt, Human
uccuucauuccaccggagucug

SEQ ID NO: 34 - RNA, 22 nt, Human
uagcagcacaucaugguuuaca

SEQ ID NO: 35 - RNA, 21 nt, Human
acagcaggcacagacaggcag

SEQ ID NO: 36 - RNA, 22 nt, Human
uagcuuaucagacugauguuga

SEQ ID NO: 37 - RNA, 22 nt, Human
ugagguaguagguuguauaguu

SEQ ID NO: 38 - RNA, 23 nt, Human
cccaguguucagacuaccuguuc

SEQ ID NO: 39 - RNA, 22 nt, Human
uguaaacauccucgacuggaag

SEQ ID NO: 40 - RNA, 23 nt, Human
cccaguguucagacuaccuguuc

SEQ ID NO: 41 - RNA, 22 nt, Human
ugagaugaagcacuguagcuca

SEQ ID NO: 42 - RNA, 22 nt, Human
ugagguaguagguuguauaguu

SEQ ID NO: 43 - RNA, 24 nt, Human
uacugcaucaggaacugauuggau

SEQ ID NO: 44 - RNA, 22 nt, Human
cauugcacuugucucggucuga

SEQ ID NO: 45 - RNA, 21 nt, Human
uucacaguggcuaaguuccgc

SEQ ID NO: 46 - RNA, 24 nt, Human
aacuggcccucaaagucccgcuuu

SEQ ID NO: 47 - RNA, 22 nt, Human
caacggaaucccaaaagcagcu

SEQ ID NO: 48 - RNA, 24 nt, Human
guccaguuuucccaggaaucccuu

SEQ ID NO: 49 - RNA, 22 nt, Human
ugagguaguagguuguauaguu

SEQ ID NO: 50 - RNA, 23 nt, Human
uaauacugccugguaaugaugac

SEQ ID NO: 51 - RNA, 62 nt, Human
aaaaaaaaagauaacuagaacuucuagaacaucuuguuuacaguuagccagaaacuauacaa

SEQ ID NO: 52 - RNA, 61 nt, Human
aaaaaaaaaggucaggguuagggaucuuacugaacugugaauuuuauuucuguuugggucc

SEQ ID NO: 53 - RNA, 62 nt, Human
aaaaaaaaccuccugggacuguugcaaggaugaaaugaaggauugagggauugagggauugc

SEQ ID NO: 54 - RNA, 61 nt, Human
aaaaaaaagaaaaaaaaaacaugcaccuguuucacugugaauagugaauguaaaggaaaga

SEQ ID NO: 55 - RNA, 62 nt, Human
aaaaaaaauugcauuuuauaugauuccugccauuugcugcuaaaucugggcuggucagaaug

SEQ ID NO: 56 - RNA, 61 nt, Human
aaaaaaacaaaagcccuggaaguugaggccaagccugcugaguauugcagcugcauuugcc

SEQ ID NO: 57 - RNA, 61 nt, Human
aaaaaaagaaaagcaaaaaacuccuguaacccuugagauuaaguucagcagguuaaagaug

SEQ ID NO: 58 - RNA, 63 nt, Human
aaaaaaagacggauccuuuuuuuuggugcaaaugggugacuuagugcauugauucagauuuuu

SEQ ID NO: 59 - RNA, 62 nt, Human
aaaaaaauuaauaaacuuuaguuguacauuuagccaguguuauuugaaguauguaacuuuua

SEQ ID NO: 60 - RNA, 62 nt, Human
aaaaaaauucuaucugguuuccccgauaaauaaucuaccucacaggggaaaaaauuaguaca

SEQ ID NO: 61 - RNA, 61 nt, Human
aaaaaaauucuuaauuuuauuggaguuuauaccacugugaaacugcaauaugacuguaaga

SEQ ID NO: 62 - RNA, 62 nt, Human
aaaaaacaaaaaaauuuaaaaagauggaauguaguguuuacauuaaagccgccguuuucaug

SEQ ID NO: 63 - RNA, 62 nt, Human
aaaaaacaaaacccucccaguguguguccgucucucaucucaauaaaagaauuuauuuuagc

SEQ ID NO: 64 - RNA, 62 nt, Human
aaaaaagaaacaaagaauuaucuuugugaucaauuguuuacagccuaugaagguaaaguaua

SEQ ID NO: 65 - RNA, 64 nt, Human
aaaaaaggaauuauguggucagugcauuguuuuuuaaacuggaaaucauuuuguuuuaaaaguu

SEQ ID NO: 66 - RNA, 62 nt, Human
aaaaaauaauuaaaaaagaaacagugcucaugucauaagcuauguugacaguugccagugga

SEQ ID NO: 67 - RNA, 63 nt, Human
aaaaaauacugucauacucuaagcuucuauuuuccacacuggacauacuucuaguuguauucu

SEQ ID NO: 68 - RNA, 62 nt, Human
aaaaaauaguuguauauaacauacauaucugccccaguguuacuucacaggccuaugcccua

SEQ ID NO: 69 - RNA, 63 nt, Human
aaaaaauauuuucucuaagauagaagaaguuauuucaguauuagcuauaggugcuaccuaccu

SEQ ID NO: 70 - RNA, 62 nt, Human
aaaaaaucccaguaauggaaugaagguaauauugauaagcuauugucuguaauaguuuuaua

SEQ ID NO: 71 - RNA, 63 nt, Human
aaaaaauuauccaauugaacgcacauagcucaaucacacuggaaauguuuguccuugcaccug

SEQ ID NO: 72 - RNA, 62 nt, Human
aaaaaauugauacaacuaugcagauuuuauaaaugugcaauaaaaguauuuguuuuucccac

SEQ ID NO: 73 - RNA, 62 nt, Human
aaaaaauugucugaaauguuuauuuugcaaaacagugcaauagaaucuaguuaugccuucau

SEQ ID NO: 74 - RNA, 64 nt, Human
aaaaacaaaaaaacaacuguucuuugccuaauaaagaacuggaacaaccaucccaaagauaaca

SEQ ID NO: 75 - RNA, 62 nt, Human
aaaaacaaagugacaauuguagaguccucaauuguguuuacauuaauagugguguuuuuacc

SEQ ID NO: 76 - RNA, 64 nt, Human
aaaaacaguacuuccaaauuuuaagguauggaaugaaugcaguacaucuggaauuguagucgau

SEQ ID NO: 77 - RNA, 61 nt, Human
aaaaacuuaucuagaaggggagaaacucccuccacugugaacaguaagccagaauaugcuu

SEQ ID NO: 78 - RNA, 61 nt, Human
aaaaagaaaagaaaaauauaauuguuugauuuuugagauuaaaacaaacaaaaagagaggc

SEQ ID NO: 79 - RNA, 62 nt, Human
aaaaagcauuuuacagggaaaaauaccucuccucaugaaggacuugaaaaguuuacaaccug

SEQ ID NO: 80 - RNA, 62 nt, Human
aaaaagggaaugaccccucagaaacccgcauuagcaguguuacucuuggaagugccuuuacu

SEQ ID NO: 81 - RNA, 62 nt, Human
aaaaaguugacucuacccccuaauuugguaggagaugaaggagaaaaggauggcauugaauu

SEQ ID NO: 82 - RNA, 62 nt, Human
aaaaauaauguaaaugucuucuauuaaauguugagugcaauaaaauacagaagaauucucuc

SEQ ID NO: 83 - RNA, 62 nt, Human
aaaaauaguaugaaaauaaaauaaauguaugaaacaguauuaaugcagaaaugugcuacuaa

SEQ ID NO: 84 - RNA, 62 nt, Human
aaaaauauuuucucuaagauagaagaaguuauuucaguauuagcuauaggugcuaccuaccu

SEQ ID NO: 85 - RNA, 63 nt, Human
aaaaaucacaaaugcuauuucacccugcagguuagcaguauuaaaauagaaacaucaaauccc

SEQ ID NO: 86 - RNA, 62 nt, Human
aaaaaucagcgucauuuguucccugccaagcaucgugcaauaagugaauuuccuggccuacu

SEQ ID NO: 87 - RNA, 62 nt, Human
aaaaaucagggauauaguucauaucccacuucuuuguuuacaccgaugucccugaauaucag

SEQ ID NO: 88 - RNA, 63 nt, Human
aaaaauccauaauauuuucugguaugaaaguuugacaguauuaauauuuuuuuuauauuuucu

SEQ ID NO: 89 - RNA, 62 nt, Human
aaaaauccuauuaaugugaaccagccaggaauaacaguguuauuucuauuggauaugguuug

SEQ ID NO: 90 - RNA, 63 nt, Human
aaaaaugcauuuaaccaugccaccuaugagugccagugacuuauuuuacuuguuuuuaauuau

SEQ ID NO: 91 - RNA, 63 nt, Human
aaaaauguagcuggcugcaaacccagugcugugaggugacuuauaugagguuccagaucaaag

SEQ ID NO: 92 - RNA, 62 nt, Human
aaaaauguauccagucugaagauguuuguguaucuguuuacauccagaguucugugacacau

SEQ ID NO: 93 - RNA, 62 nt, Human
aaaaauuaucuucucugauauucggauguaauggucaucucaguucagcccccuaggaaaca

SEQ ID NO: 94 - RNA, 62 nt, Human
aaaaauucaaaccacauguuuauuuuuuuuuugccuaccucauuguucuuaaugcauugaga

SEQ ID NO: 95 - RNA, 62 nt, Human
aaaacaagauacauacauaguauaacacaccucacaguguuaagauuuauauugugaaauga

SEQ ID NO: 96 - RNA, 62 nt, Human
aaaacaauugagaugcuaacagggaggauuacaguguuuacagaacaaccuucagcgccgac

SEQ ID NO: 97 - RNA, 62 nt, Human
aaaacaggcaacguguucuuguaaccuuuauuucaugaaggacuucuuuuuguuucuaacua

SEQ ID NO: 98 - RNA, 62 nt, Human
aaaacauauccacaacauuggcuugaugugaucaucaucucauaacugagcaagaagacuau

SEQ ID NO: 99 - RNA, 62 nt, Human
aaaacauguuauuguacuguguaaagaugcauagucaucucauuugguuggcuuuguaccuu

SEQ ID NO: 100 - RNA, 62 nt, Human
aaaaccaaacagagacagcuuccagcaccuucuucaguguuaccaucucuaagaaggaacca

SEQ ID NO: 101 - RNA, 64 nt, Human
aaaaccacauacacacuuuauuuaagauuaaaaucuaacuggaaagucagcuuggaaaauggac

SEQ ID NO: 102 - RNA, 61 nt, Human
aaaacgggaaucucauuuagacuuuaauuuuuuugagauuaucggcggcacaaucacuuug

SEQ ID NO: 103 - RNA, 62 nt, Human
aaaacuggggugcacucagcucucacagggguaaucaucucaagugguauuuguagccaagu

SEQ ID NO: 104 - RNA, 62 nt, Human
aaaacuuaacaggccaucacaagcaauugucuuuuguuuacaagauugauuuaauaugagag

SEQ ID NO: 105 - RNA, 63 nt, Human
aaaagaaaaaaaaucacaaaauacuggcuacagacacacuggacagguguguggucugcagaa

SEQ ID NO: 106 - RNA, 62 nt, Human
aaaagacaguggagaauuuacggaaugacaugaaugcugcuaaaggacuggacucaaacaaa

SEQ ID NO: 107 - RNA, 63 nt, Human
aaaagaccuuucccucucccugccccuagaacaaccaguauuagaaggugccaccauuggugc

SEQ ID NO: 108 - RNA, 62 nt, Human
aaaagagaugaugaaaauauuuaaaggcccuaucuguuuacaguguuccgugguuaaacucg

SEQ ID NO: 109 - RNA, 62 nt, Human
aaaagagcuggugguuugaucauuucugccaugauguuuacaagauggcgaccaccaaaguc

SEQ ID NO: 110 - RNA, 62 nt, Human
aaaagagcuuguccaugaacccagguucucacucuguuuacagaaguguguugaguacaguu

SEQ ID NO: 111 - RNA, 61 nt, Human
aaaagaguuugguucugcuguaaauccuugccgccugcugaaacauggugugcaggucaac

SEQ ID NO: 112 - RNA, 62 nt, Human
aaaagaugaggacucagaaguucaagcuaaauauuguuuacauuuucugguacucugugaaa

SEQ ID NO: 113 - RNA, 63 nt, Human
aaaagcacuugggagauuuggaugauuugagaagagugacuuaaaaaaaaugcuucugugcuc

SEQ ID NO: 114 - RNA, 64 nt, Human
aaaagcagagauaacacuucccaacucauuuugugaggccaguauuacccuaauagcaaaacca

SEQ ID NO: 115 - RNA, 63 nt, Human
aaaagcagaguuagauuuuugcacauuaaaaaauucaguauuaauuaaacauuacuuauucua

SEQ ID NO: 116 - RNA, 64 nt, Human
aaaagccuuguguaaauaugagauguugucaaaaugaugcaguaaaugagcaaugacaguguac

SEQ ID NO: 117 - RNA, 61 nt, Human
aaaagcgucugucucuuguuuucuaguccaguuugagauuaauuuagaagaaaggaauacu

SEQ ID NO: 118 - RNA, 62 nt, Human
aaaagcucagacaguuggcagacguccaguuagcucaucucacucacucugauucuccugug

SEQ ID NO: 119 - RNA, 58 nt, Human
aaaaggagaaagccacuaaggguacaaaagacacuggacaaccauauugcaaucagau

SEQ ID NO: 120 - RNA, 62 nt, Human
aaaaggaugggucccacccucccuccagagccaccaguguuagagcggagcccaaaggaagg

SEQ ID NO: 121 - RNA, 62 nt, Human
aaaaggcaguggcaaguaaguuauagaagagaaaugcugcuagaaggaauuaagcguuguag

SEQ ID NO: 122 - RNA, 62 nt, Human
aaaaguaaauuaaaaacaaaaccugaugaaacagaugaaggaagauguggaaaaaauccuua

SEQ ID NO: 123 - RNA, 63 nt, Human
aaaaguaagaccaagaaaaaacaaacuaaagacaugugacuuauucaaugaaagugaaaaaga

SEQ ID NO: 124 - RNA, 62 nt, Human
aaaagugacauauugucuauuacaugggcccaaucaguauuaaaguacuccccuuacucaaa

SEQ ID NO: 125 - RNA, 64 nt, Human
aaaaguugaccuugagaauuuauaauauucugagaaaacuggaagcaugcauaaagccccucug

SEQ ID NO: 126 - RNA, 62 nt, Human
aaaaguuggggguggguaagagggauaguuaaaauguuuacaaaacuuuaggcucccucgga

SEQ ID NO: 127 - RNA, 62 nt, Human
aaaauaauaaaacccacuuauauuugcuugaguguguuuacaagucaauuuccuuuuaugua

SEQ ID NO: 128 - RNA, 61 nt, Human
aaaauaauagcuauucaagaaaaucaccaagugacugugaaaccgucaguucggaaggcug

SEQ ID NO: 129 - RNA, 64 nt, Human
aaaauaauuaaauaaaugaauaaauccaaaacaaacaugcaguacuuuuguuguaugggauugg

SEQ ID NO: 130 - RNA, 64 nt, Human
aaaauaauucacacuaucagacuagcaaggcacuagaacuggaaaagaccacagaaaacaaaga

SEQ ID NO: 131 - RNA, 64 nt, Human
aaaauaauuuguuauaaaaauucuguuugcaaauuaaacuggaaaaguauccagagucucaaaa

SEQ ID NO: 132 - RNA, 63 nt, Human
aaaauacagggucccugagccagccuaaggcauaagugacuuaucccuccucccugcucacau

SEQ ID NO: 133 - RNA, 63 nt, Human
aaaauagcauuuaucuuauuucucuauuuuauguugugacuuaaccuaauuuuauuuuuuuaa

SEQ ID NO: 134 - RNA, 64 nt, Human
aaaauagucaaacaggugacaaccacacuuggcguuaacuggaagcuacacacuccauaccauc

SEQ ID NO: 135 - RNA, 64 nt, Human
aaaauaucuguuuuuaauguuuuguuucucccuccaggccaguauaaagggacuugaaguauuu

SEQ ID NO: 136 - RNA, 64 nt, Human
aaaauauuuauaguagugguguucacaauagucccaaacuggaaacccaaguguccaucuccau

SEQ ID NO: 137 - RNA, 62 nt, Human
aaaaucacaaaugcuauuucacccugcagguuagcaguauuaaaauagaaacaucaaauccc

SEQ ID NO: 138 - RNA, 62 nt, Human
aaaaucacuauaaggcagcucuaaauuugccuugauaagcuaaauaaauuacuuuuauaacu

SEQ ID NO: 139 - RNA, 62 nt, Human
aaaauccauaauauuuucugguaugaaaguuugacaguauuaauauuuuuuuuauauuuucu

SEQ ID NO: 140 - RNA, 64 nt, Human
aaaaucgccaggacuggugaauauaaaugaugauugaacuggaauaauauuggggaccaaauca

SEQ ID NO: 141 - RNA, 64 nt, Human
aaaaucuggaugacaaagcauaucguaauaucaaggaacuggaaaauuaugcugaaaacacaca

SEQ ID NO: 142 - RNA, 62 nt, Human
aaaaucuuuucuucucuguaucaguuaauucugacaguguuagugauucugucuucauuaua

SEQ ID NO: 143 - RNA, 63 nt, Human
aaaaugaaaaagaaaaaaaaagcugcacauuuacagugacuuaagaccuggucuucuuucucu

SEQ ID NO: 144 - RNA, 62 nt, Human
aaaaugaaugccgaauuugguacacauguguuaucuaccucaagguaacaagaguauguggc

SEQ ID NO: 145 - RNA, 62 nt, Human
aaaaugcaguauuuacugucccagccucucugugucaucucauccugauuagaagcccacau

SEQ ID NO: 146 - RNA, 62 nt, Human
aaaaugggucauuuuauuuuuauuauacucaucuuguuuacaccuauacauaaacagaaaac

SEQ ID NO: 147 - RNA, 62 nt, Human
aaaauguauaaagggcaacacaugagcugucaaacaguguuaggaguguguuuauauguaca

SEQ ID NO: 148 - RNA, 61 nt, Human
aaaauguugccagaauuauacuaaacuguuggaugagauuaggagaucagaggcuggaccu

SEQ ID NO: 149 - RNA, 62 nt, Human
aaaauuaauauguugucagugauuagaacaacacuguuuacauaaaaaccauuuuucuaauu

SEQ ID NO: 150 - RNA, 61 nt, Human
aaaauugaagacacauucagagguuugauugguugagauuaacugguguggugguuggugu

SEQ ID NO: 151 - RNA, 63 nt, Human
aaaauuguuaugaacuauaguauuuuagaugaugagugacuuauuuuaauuccacuuuaacau

SEQ ID NO: 152 - RNA, 61 nt, Human
aaaauuuuagcuuaaggacauuuuaaaauugcaugagauuagcaaaauuauuaauuuaaaa

SEQ ID NO: 153 - RNA, 61 nt, Human
aaacaaagaaguaccuggaguggagagaguauuccugcugaaacgcgcauaggaagcuuuu

SEQ ID NO: 154 - RNA, 62 nt, Human
aaacaaagcaucuaucucugaaagcuguuuggcgaugaaggagauucuucguguuguguuca

SEQ ID NO: 155 - RNA, 62 nt, Human
aaacaaauuaagaguuauucauucaaauuuuuugcaguguuaaucuguaaaugauggcuuga

SEQ ID NO: 156 - RNA, 64 nt, Human
aaacaaauuuaauaacuuuaugggugagguacuuugggccaguagaguauacuacaguuauguu

SEQ ID NO: 157 - RNA, 62 nt, Human
aaacaacuucagcaaaugguaaaaugaacaugugcaguguuaaaggcaggccuuaggcuccu

SEQ ID NO: 158 - RNA, 62 nt, Human
aaacaacuuuaaaugcuuguagcagaaccccgggucaucucaugucagaaaccuuuaaucca

SEQ ID NO: 159 - RNA, 62 nt, Human
aaacacauucuuauuaauucuucaccuguuauguaugaaggaaucauuccagugcuagaaaa

SEQ ID NO: 160 - RNA, 62 nt, Human
aaacacccgucugggaaggccccaaggucagcuuaugaaggaccccacuugcaccccacccc

SEQ ID NO: 161 - RNA, 62 nt, Human
aaacagaacagaaagguguggugcuggaacaucgaugaaggagcccuacuuacugagcuuag

SEQ ID NO: 162 - RNA, 62 nt, Human
aaacagagucucaagacccccgcucuggacugucauaagcuagcacccgugguaagcgggac

SEQ ID NO: 163 - RNA, 62 nt, Human
aaacagauuugauaaucuuauucacaguuguuauuguuuacagaccauuuaauuaauauuuc

SEQ ID NO: 164 - RNA, 61 nt, Human
aaacagugaccuuauauuauugcuaagggaauaugagauuaacuuccuacaggggccaaaa

SEQ ID NO: 165 - RNA, 63 nt, Human
aaacagugguauuuuaagacaguuuuguuauacaugugacuuacuuuugacucagccugagag

SEQ ID NO: 166 - RNA, 62 nt, Human
aaacauaagccauuuugcuugcaauauguaugaaucaucucaaaaccauaaugguaugagcc

SEQ ID NO: 167 - RNA, 64 nt, Human
aaacauaccuaacuuucuugcaauaaaugcaaaagaaacuggaacuugacaauuauaaauagua

SEQ ID NO: 168 - RNA, 62 nt, Human
aaacauauccacgguaaccggucccuggcaauucuguuuacaugaaauggggagaaagucac

SEQ ID NO: 169 - RNA, 61 nt, Human
aaacauccagguagcaagcuucagagagaauagacugugaauguuaaugccagagagguau

SEQ ID NO: 170 - RNA, 63 nt, Human
aaacauguguuucucuuauggauuuuaauaagcuccaguauuauucaaaugaucaaaaauaua

SEQ ID NO: 171 - RNA, 63 nt, Human
aaacauuuaucagaaauuuuaauacucugcauaaccaguauuagcauuagaaauuagccacuu

SEQ ID NO: 172 - RNA, 64 nt, Human
aaacauuugauuaucauuugacaaauaccuagguauaacuggaauuuucauguuugaaguucua

SEQ ID NO: 173 - RNA, 61 nt, Human
aaaccaauccauggcaacgcuggugcuugauacacugugaagugaauacaacauugaacag

SEQ ID NO: 174 - RNA, 61 nt, Human
aaaccagaagauuguuaugaguacuuaaaccucacugugaaauaaugauauauuuugcaau

SEQ ID NO: 175 - RNA, 62 nt, Human
aaaccagccaguaauuucugugcaaccuuacuaugugcaauauuuuuaaauccugagaaaug

SEQ ID NO: 176 - RNA, 61 nt, Human
aaaccauuuugguuggaaugauaacauaacuaaccugcugacagcugcuucugcuaggugc

SEQ ID NO: 177 - RNA, 64 nt, Human
aaacccaggagugagagggauuuccccucauaguacaacuggaaggauagugcuuguaaagagu

SEQ ID NO: 178 - RNA, 62 nt, Human
aaaccccuuugauuuaaaaauguauuuuuaaaaauguuuacauugaugaugaguaauauugc

SEQ ID NO: 179 - RNA, 62 nt, Human
aaacccuugccucaucaguuuuccugauuuacaagugcaauauuuuagccaaugccuuggga

SEQ ID NO: 180 - RNA, 61 nt, Human
aaaccgucaaccaagaagucaagaccacuguccccugcugaguuaggcaaucacuuaaaac

SEQ ID NO: 181 - RNA, 62 nt, Human
aaaccuacacacugucaugcuucaucauucccucucaucucagguagaagguugacacaguu

SEQ ID NO: 182 - RNA, 62 nt, Human
aaaccuauuaaaaaugauacuuagacagaauugucaguauuauucaagaacauuuaggcuau

SEQ ID NO: 183 - RNA, 62 nt, Human
aaaccugaaacugguaagacaagcacaaagcaacgugcaauacaaaaaucguaucucaaggg

SEQ ID NO: 184 - RNA, 62 nt, Human
aaaccugacucuuugcacguguaauucccagagucuaccucaguuaaccaggcuuaguuuua

SEQ ID NO: 185 - RNA, 63 nt, Human
aaaccugugucaugccugugugcauacccaauuaaacacuggaaauaaaaauuguuuuggugu

SEQ ID NO: 186 - RNA, 61 nt, Human
aaacgaggcuucccacacugccaggggagccucacugugaagucuaggcucagacaggcau

SEQ ID NO: 187 - RNA, 64 nt, Human
aaacgcaaagcuguugcacauggcgauaaauuauggaugcaguacauugaagagagaugaaguc

SEQ ID NO: 188 - RNA, 62 nt, Human
aaacgcuuuuauagcuuucaaauauaccuaaucuuguuuacauuaacauuucuuaauuugau

SEQ ID NO: 189 - RNA, 63 nt, Human
aaacggaauaugcaucgcucuuaaccuugagcauagugacuuagagacacuguguaucaguuu

SEQ ID NO: 190 - RNA, 61 nt, Human
aaacguaacaguaaggaaaaaaucacccacaaaccugcugaguuugaaucacuggcaacuu

SEQ ID NO: 191 - RNA, 63 nt, Human
aaacgugcagaaauuuuggagggcugugauuuuuccaguauuaaacaugcaugcauuaaucuu

SEQ ID NO: 192 - RNA, 62 nt, Human
aaacguucccacaaugcacaaauuaagaaucuauauaagcuauaaaaauacucauuuuuuaa

SEQ ID NO: 193 - RNA, 62 nt, Human
aaacuagacgggugggggacacuagaaugaaaaccaguguuaggguaaagacaaaacagacu

SEQ ID NO: 194 - RNA, 63 nt, Human
aaacuaggaaauuacuaaguauaaagaagaaaaaccaguauuaauuaagugaugagaccuguu

SEQ ID NO: 195 - RNA, 61 nt, Human
aaacucccaguucgugcaucccagccaccacccugagauuaugcggcucuucccucgggcc

SEQ ID NO: 196 - RNA, 62 nt, Human
aaacugccauaaauuuucuaguuccaguuuaguuugcugcuauuagcagaaacucaauuguu

SEQ ID NO: 197 - RNA, 63 nt, Human
aaacuggcccuauuacuccugcuuagaacccuguagugacuuaucauggccucugaaaaaucu

SEQ ID NO: 198 - RNA, 62 nt, Human
aaacuggcuguacaauaucuaaaaagaaagugacaugaaggaagcaaucuacaacuuccuuc

SEQ ID NO: 199 - RNA, 61 nt, Human
aaacugucuuuggauguucaaaugagaaacaaaacugugaagagaaggaacuggcguauac

SEQ ID NO: 200 - RNA, 62 nt, Human
aaacuuaagcaagcaagcguguauuuuccuugucugcugcuauuugaaguaauuaguacagc

SEQ ID NO: 201 - RNA, 62 nt, Human
aaacuuccaauuaugucuauaauuuauauucuuuuguuuacaugaugaaacuuuuuguuguu

SEQ ID NO: 202 - RNA, 62 nt, Human
aaacuuucuuaacaaacccaauuucuacaaauguuguuuacaucaaauuggacagggaugca

SEQ ID NO: 203 - RNA, 64 nt, Human
aaacuuugagaaagaaacaacacugauauuucaagcaacuggaagcuuuugaauuuuuucauau

SEQ ID NO: 204 - RNA, 62 nt, Human
aaagaaaaacaauuauuuuguccuguuucucaaacaguguuaagcaguuuuguuaauagaca

SEQ ID NO: 205 - RNA, 63 nt, Human
aaagaaaauuccccacuuggaaagaaagaggaggaacacuggauucuuacuuucuggaucuug

SEQ ID NO: 206 - RNA, 62 nt, Human
aaagaaacaaacauugaauuacuaaacaaagauggugcaauaucuuuguuuuuuuuuuauga

SEQ ID NO: 207 - RNA, 62 nt, Human
aaagaaaccaagaauuuuccauuuugugaucaauuguuuacagcccgugauggugauguguu

SEQ ID NO: 208 - RNA, 62 nt, Human
aaagaaagcaugaagaaacaacuacaaaaaguuaucaucucaggauacuugauacgcaacac

SEQ ID NO: 209 - RNA, 62 nt, Human
aaagaaauaagauaugaugauugauuacuuggaccaguguuagaccgaccuguguuagacga

SEQ ID NO: 210 - RNA, 62 nt, Human
aaagaaauguauugauguugaaguauauuuauugaugaaggaaauuguucacaauauuucag

SEQ ID NO: 211 - RNA, 64 nt, Human
aaagaagaagaauuuauugaauauuuauacuauaaaaugcaguaacauucuacuugcuuauuac

SEQ ID NO: 212 - RNA, 61 nt, Human
aaagaauuuuuuacaugucacugucaggagcucacugugaauguguugucuucaaaugguu

SEQ ID NO: 213 - RNA, 62 nt, Human
aaagacaacccagcaaugccugcagggcugauguaugaaggaguuucccaagagccccugaa

SEQ ID NO: 214 - RNA, 62 nt, Human
aaagacacaugcacacguauguuuauugcagcacuguuuacaauagcaaagacuuggaacca

SEQ ID NO: 215 - RNA, 62 nt, Human
aaagaccuuucccucucccugccccuagaacaaccaguauuagaaggugccaccauuggugc

SEQ ID NO: 216 - RNA, 63 nt, Human
aaagagcuggagcucccucuaucuucucugcugucacacuggaaggcagccucuuuuuguccu

SEQ ID NO: 217 - RNA, 64 nt, Human
aaagaguagccgauuuuagaguucuuuuggaucauaaacuggaaauacugauggaagcacacaa

SEQ ID NO: 218 - RNA, 62 nt, Human
aaagaguauuuauguuggaauaauuuuuaaauaauguuuacauaacuguaaguccuguuugg

SEQ ID NO: 219 - RNA, 62 nt, Human
aaagauauuuuuaaucugucaauuauuucagucaucaucucaucguccuagaaagccugguc

SEQ ID NO: 220 - RNA, 63 nt, Human
aaagaucuccuucaguugggaguccuuccacuucaacacuggagaacugagccuugcaucucu

SEQ ID NO: 221 - RNA, 62 nt, Human
aaagaugacccaaugugaaaugucuguagucaguuguuuacaaacucccucuccugcacaau

SEQ ID NO: 222 - RNA, 62 nt, Human
aaagcaaaaaauagaagcuucauuuuugauauauuguuuacagccugugaaagugauuuauu

SEQ ID NO: 223 - RNA, 62 nt, Human
aaagcaaucaguuaaugucuuuagcacacuaaagcaguauuaaacacagguacaaguuggaa

SEQ ID NO: 224 - RNA, 61 nt, Human
aaagcacaaagaauugauucauguucaucaauaccugcugagaguacugucccaggaauau

SEQ ID NO: 225 - RNA, 62 nt, Human
aaagcacuggaauguuuugugagauuauuuuuauaugaaggaauagccugaacucaaacaga

SEQ ID NO: 226 - RNA, 62 nt, Human
aaagcagaguuagauuuuugcacauuaaaaaauucaguauuaauuaaacauuacuuauucua

SEQ ID NO: 227 - RNA, 62 nt, Human
aaagcagguugagauggggaagaugacagaacaacaguguuaaauggccauuugcacaggcc

SEQ ID NO: 228 - RNA, 64 nt, Human
aaagcauacauaugugauuauggcuaaaucaaagguaacuggaauguauauacuuuugcuaaug

SEQ ID NO: 229 - RNA, 64 nt, Human
aaagcaucuuagaaguuuaacagauugguucagaagaacuggaaaauauuauuuuguuuaacag

SEQ ID NO: 230 - RNA, 63 nt, Human
aaagcaugauuuaaaauuuuuuaaagugagcugugacacuggaaagcucuucauuuuaucuuu

SEQ ID NO: 231 - RNA, 62 nt, Human
aaagcccugggccacugccauuggguuagucaagaugaaggaggaggacuggcugccuccau

SEQ ID NO: 232 - RNA, 62 nt, Human
aaagcccuugcacagcuggagaaauggcaucauuauaagcuaugaguugaaauguucuguca

SEQ ID NO: 233 - RNA, 61 nt, Human
aaagcgagugauuaggcagcagcugaagccaccccugcugaugaugagcaagugccugcug

SEQ ID NO: 234 - RNA, 61 nt, Human
aaagcuaacauggucccaugccuuccaggcagcccugcugaaggaucuaaguuggcccugu

SEQ ID NO: 235 - RNA, 62 nt, Human
aaagcucuacacaaagcuaaauauaguguaauaauguuuacacuaauaagcaaauauguuaa

SEQ ID NO: 236 - RNA, 62 nt, Human
aaagcuucuguuaguguauacacgaauuccgcuguguuuacauauuuaaaaaugccauuguu

SEQ ID NO: 237 - RNA, 62 nt, Human
aaagcuuuaggucaggcaaagaauuaauuucauuuguuuacaaaguagauuaugccuaauaa

SEQ ID NO: 238 - RNA, 62 nt, Human
aaaggaaaucgccuagcuccaggcuguguuaggacaguauuagcaugaaggcugugcgacca

SEQ ID NO: 239 - RNA, 50 nt, Human
aaaggagcaacuugaauagaauacugugaacuaaccaaaccaaaaccaac

SEQ ID NO: 240 - RNA, 62 nt, Human
aaaggagggagcuacucucaggcugcaaguaaguaugaaggaggcugaucccugagauccuu

SEQ ID NO: 241 - RNA, 61 nt, Human
aaaggauuuaaauacuggaauuugaaaagccaaacugugaaaccauugggagaaaauagau

SEQ ID NO: 242 - RNA, 62 nt, Human
aaaggcucaauaacaaauacaacaaauguaaauauguuuacauuuuaagacauaugcagugg

SEQ ID NO: 243 - RNA, 62 nt, Human
aaaggcucuuaaagagcaaauguccucuucuccuugcugcuagagugggaggagaaagaugu

SEQ ID NO: 244 - RNA, 64 nt, Human
aaagggaacucucucuacuucgcaaaagacuagaagaacuggaaacaacacaaagaaaacaacu

SEQ ID NO: 245 - RNA, 62 nt, Human
aaagggcaguggauucuggaggcucuacuucaggugcugcuauaaugccucaucuaaucagg

SEQ ID NO: 246 - RNA, 62 nt, Human
aaagggcuucagugucgauugagauugcuuuuguucaucucagggauuucaauagucaagaa

SEQ ID NO: 247 - RNA, 62 nt, Human
aaaggggggaaccagugaaaaugaaaggaaguuucaguauuagaugcacuuaaguuagccuc

SEQ ID NO: 248 - RNA, 62 nt, Human
aaaggguaaccaguagguguggcauugaauuggccaguguuagcaucuacagccaucaccga

SEQ ID NO: 249 - RNA, 62 nt, Human
aaagggugagccuacaguaagacacuucuaucagcaguguuaauggaagaaauuccuaccaa

SEQ ID NO: 250 - RNA, 63 nt, Human
aaagggugcacaagagcuuacuucacccugaaaaucaguauuauuaaugaaaaguacuguuuu

SEQ ID NO: 251 - RNA, 62 nt, Human
aaaggucccuuuaugaguuauuccuucuuucaguucaucucacuggagcacagccaagaugg

SEQ ID NO: 252 - RNA, 62 nt, Human
aaagguggguggauaaaguuuucaauacuuucuacuaccucaguuuacuugaguacuacauu

SEQ ID NO: 253 - RNA, 64 nt, Human
aaagguuaagaaagcaagccagauuuacugcacaauaugcaguacccaguacuacuuuaaaucc

SEQ ID NO: 254 - RNA, 62 nt, Human
aaagguuuugguaaaacuuuuucaugccagaugcuguuuacaacaaugaacaugccaauaaa

SEQ ID NO: 255 - RNA, 63 nt, Human
aaaguaaugguucucauagugguauaaaguucacacaguauuaugacacucccagcguaucau

SEQ ID NO: 256 - RNA, 63 nt, Human
aaaguacagugcaacauauacaaauugacugagugcaguauuagauuucaugggagcagccuc

SEQ ID NO: 257 - RNA, 64 nt, Human
aaaguaggcuaagaccuuccacuuaaaagcauguuuaacuggaaguugagagucugcuuuguac

SEQ ID NO: 258 - RNA, 62 nt, Human
aaaguccaucucucaauacuuauacuuucuaaauucaucucagaauauuagcagccauauuc

SEQ ID NO: 259 - RNA, 62 nt, Human
aaagucuagugucgacugguguuuucccucgugauguuuacagcuugcuguuugcugcccag

SEQ ID NO: 260 - RNA, 61 nt, Human
aaagugaauguaaauggugguuaaaauuacauuacugugaaauucaucuuccaacucuaag

SEQ ID NO: 261 - RNA, 62 nt, Human
aaagugacaugcauucacauaucugcuuaucagugugcaauacuguguaccucauggaugcu

SEQ ID NO: 262 - RNA, 64 nt, Human
aaagugcugggauuacaggugugagccaccacacuuggccaguauauccucaguaugaagauau

SEQ ID NO: 263 - RNA, 62 nt, Human
aaagugguauuacagacauucagugacaaugaaucaguguuaauucuaaauccuugauccuc

SEQ ID NO: 264 - RNA, 63 nt, Human
aaaguuaccuuaauaguccucuuguguuauuaggacaguauuauuauaguacuuauuuauuuu

SEQ ID NO: 265 - RNA, 62 nt, Human
aaaguucucaggaacaaaagccagagcauggaaacaguguuaaguuuaucaccaucuuugaa

SEQ ID NO: 266 - RNA, 63 nt, Human
aaaguucugcuguaccuccaguggaugcuguuucucaguauuaugacaugugacaggugaacu

SEQ ID NO: 267 - RNA, 62 nt, Human
aaaguucuggcuuagcagcugcaggcaagcauuaugcugcuauugaagaagcauuaggggua

SEQ ID NO: 268 - RNA, 62 nt, Human
aaaguugccagagacgaguaugcccaugcucccucuaccucacugccaccacuccugcuguu

SEQ ID NO: 269 - RNA, 62 nt, Human
aaaguuggaucacuaguggccagcauccccagaguuccguuaguaaacuuacuucauauguc

SEQ ID NO: 270 - RNA, 62 nt, Human
aaaguuguucaaauauaauauauuuuuugagaggcaguguuaaugaucuaggaaacccuggg

SEQ ID NO: 271 - RNA, 63 nt, Human
aaaguuugccaaccauaagugucaaaagcacaggccaguauuaagcagaaguucuaccaccuu

SEQ ID NO: 272 - RNA, 64 nt, Human
aaaguuugggggugcaauauaagaaguuuauauaauaugcaguacauuauccaaaagagaaggu

SEQ ID NO: 273 - RNA, 64 nt, Human
aaauaaacuauuuuguagaagaucagacuccuacuuaacuggaagagaaaugucuauuaaaugu

SEQ ID NO: 274 - RNA, 61 nt, Human
aaauaauauuuuagucuucugcuugaggaacugacugugaagcgacgcccagugaaaaaca

SEQ ID NO: 275 - RNA, 62 nt, Human
aaauaauuaugaaugccacugaggcacugaggcccuaccucaugccaaacaaaggguucaag

SEQ ID NO: 276 - RNA, 63 nt, Human
aaauacaaguggccaauagcacauaagaagaugcccaguauuacagccaagaggaaaaugcaa

SEQ ID NO: 277 - RNA, 62 nt, Human
aaauacagugucugaguuuucaucggucuucacaugcugcuauauauuccacagaguuccuu

SEQ ID NO: 278 - RNA, 62 nt, Human
aaauaccucauuagugugaauaccugaaaccugccuaccucauaggacagcugugaggauca

SEQ ID NO: 279 - RNA, 62 nt, Human
aaauacgaaauuagaaaagcccucccuauuuuaacuaccucaacuggucagaaacacagauu

SEQ ID NO: 280 - RNA, 62 nt, Human
aaauacgggagaggcaccaaaccccuaaauucuagugcaauaauuucaagccauaccggcca

SEQ ID NO: 281 - RNA, 61 nt, Human
aaauacugauaaacaaaauguaaagguaaugagugagauuacaaauguauuugugcgugca

SEQ ID NO: 282 - RNA, 62 nt, Human
aaauagaaauaagugguuauuucucaacaaagcacaguguuaaaugaaauuguaaaaccugu

SEQ ID NO: 283 - RNA, 62 nt, Human
aaauagaguuuuuaccaaaaaaagauguuuguucucaucucaguaggccucauuugggcaag

SEQ ID NO: 284 - RNA, 62 nt, Human
aaauagcaguuuuaaaaguuuucuauuucaguuuuguuuacacuccuaauugcuuuaagcac

SEQ ID NO: 285 - RNA, 62 nt, Human
aaauaggaaaaugaagaaaucuuucucucugacuuguuuacaucauuucacggaaacacauc

SEQ ID NO: 286 - RNA, 62 nt, Human
aaauaggagauuuuguaacugcuugccauuaacuugcugcuaaauucccaauguauugauua

SEQ ID NO: 287 - RNA, 62 nt, Human
aaauagggcaaguuuauguuucaugcgagaaaacaugaaggaggguuuugguuuuggucugc

SEQ ID NO: 288 - RNA, 61 nt, Human
aaauaggguuggcacugacuauaucucugcuugacugugaauaaagucagcugugcaguau

SEQ ID NO: 289 - RNA, 64 nt, Human
aaauauauaaaacagcucaagaauaugcuguacauaaacuggaauucuauaaagcucacaaagu

SEQ ID NO: 290 - RNA, 62 nt, Human
aaauauauuugauguuaaaucaaauagaugauucuguuuacauuguucauaugaauaauaau

SEQ ID NO: 291 - RNA, 61 nt, Human
aaauaugauaguaauaaaauagagcauaacgaaacugugaaacuuucugaagccuugucag

SEQ ID NO: 292 - RNA, 62 nt, Human
aaauaugucuuuaaguauuuuagacauuccucgucaguauuaggaauuuccaugggaaaaga

SEQ ID NO: 293 - RNA, 61 nt, Human
aaauauuguuuaccauuacaugauuaugaaaugacugugaagaauauaaaauuaaacuuag

SEQ ID NO: 294 - RNA, 64 nt, Human
aaauauuugggauggaacucccuacugaccucugagaacuggaaacgaguuuguacagaaguca

SEQ ID NO: 295 - RNA, 64 nt, Human
aaauauuuuuaaaaccuucuuaacaaaacuucuuaaaacuggaaaaaauauauauuauguaucu

SEQ ID NO: 296 - RNA, 63 nt, Human
aaaucaauucauguuuaacguuucucauuaaaauccaguauuauauuaucauaucucucuuua

SEQ ID NO: 297 - RNA, 61 nt, Human
aaaucaccuuauugauuucuauccccaaaaaagccugcugaaauuuguauugagauggaau

SEQ ID NO: 298 - RNA, 64 nt, Human
aaaucauacuucuuaggguuaugauuaaguaaugauaacuggaaacuucagcgguuuauauaag

SEQ ID NO: 299 - RNA, 61 nt, Human
aaaucauggaauguucugagucccugaggguuuacugugaagugcugaggacaguguugac

SEQ ID NO: 300 - RNA, 62 nt, Human
aaauccauccuuauuucuuauucagugcugaauacuaccucaugcaaaauauugguguggcu

SEQ ID NO: 301 - RNA, 64 nt, Human
aaaucccagaacucaccacucaccaugggccuuuaaaugcaguaaacuccaccuaaccagauuc

SEQ ID NO: 302 - RNA, 61 nt, Human
aaaucccuguggagacuauaccacuauuuuuucugagauuaauguacucuuggagcccgcu

SEQ ID NO: 303 - RNA, 61 nt, Human
aaauccuacaaauauugucagcuuucaguguagugagauuauuccuguagguuauggggua

SEQ ID NO: 304 - RNA, 62 nt, Human
aaauccuauuaggcaagucaguugaaaaugcucgugcugcuaauggaauuagagugcguuca

SEQ ID NO: 305 - RNA, 62 nt, Human
aaaucuagaaaauauucaugcuucuaaguuucugcaguguuacuguaagagagugucucguc

SEQ ID NO: 306 - RNA, 64 nt, Human
aaaucuauauacaccaaagcccucccuccacaaaaaaacuggaaauguucuaauaaaugucuga

SEQ ID NO: 307 - RNA, 62 nt, Human
aaaucugagacuugauguauuuuuucauuuuguccaguguuaccaacuaaauugugcaguuu

SEQ ID NO: 308 - RNA, 63 nt, Human
aaaucuguagaauucuaaccuucuaacaccugugacaguauuaccacucuucuuguauuauag

SEQ ID NO: 309 - RNA, 62 nt, Human
aaaugaacccaguuuaagaauuugccaucaguagcaguauuaagcagugguuaaugucuuag

SEQ ID NO: 310 - RNA, 54 nt, Human
aaaugaauccacauucuaguuccuuuaugcaguauacaaggagaacuguccugu

SEQ ID NO: 311 - RNA, 62 nt, Human
aaaugacaggugaaacuccauuacuggcuuguacuguuuacagcaaguugucuaacccgcgg

SEQ ID NO: 312 - RNA, 61 nt, Human
aaaugacccacccaccucagccucccaaagugcugagauuacaggcgugaggcacugcgcc

SEQ ID NO: 313 - RNA, 62 nt, Human
aaaugaccuuaccuguaauacagucuuguuugucuguuuacaaccauguauuuauugcaaug

SEQ ID NO: 314 - RNA, 63 nt, Human
aaaugagagagcaguuuaguuguugcauuuuucggacacuggaaacauuuaaaugaucaggag

SEQ ID NO: 315 - RNA, 64 nt, Human
aaaugaggggaaaagguucaggcuguuaacaauuccaugcaguauuuaaauacauuuacuuugg

SEQ ID NO: 316 - RNA, 62 nt, Human
aaaugaggggagucagcagugaucaugggggaaauguuuacauuuuuuuuuucuucagaagu

SEQ ID NO: 317 - RNA, 63 nt, Human
aaaugauacucagaagcaacuuucugaagaacagaacacuggaauauuacaagaugagauucu

SEQ ID NO: 318 - RNA, 63 nt, Human
aaaugauacucagaagcaauuuugugaagaacagaacacuggaauauuacacgaugagauucu

SEQ ID NO: 319 - RNA, 62 nt, Human
aaaugaucaucucuagguuggggauggcaaauaaucaucucaacugccaauuccaagugucu

SEQ ID NO: 320 - RNA, 61 nt, Human
aaaugauuuauuuuuuaugaaaauguuaacugaugagauuauaucuacauacguguguuau

SEQ ID NO: 321 - RNA, 62 nt, Human
aaaugcaugcaauacuuauaagacuuaaaaauuguguuuacagaugguuuauuugugcauau

SEQ ID NO: 322 - RNA, 61 nt, Human
aaaugccaaaaucucagcggacucgauaaucugccugcugauguuccuucuguggcugugu

SEQ ID NO: 323 - RNA, 62 nt, Human
aaaugccaaauuuauuaaggugguggagccacugcaguguuaucuuaaaauaagaauauuuu

SEQ ID NO: 324 - RNA, 61 nt, Human
aaaugcgccaaggguucagugucugucuucagcccugcugaacgaagaggauacuaaagag

SEQ ID NO: 325 - RNA, 63 nt, Human
aaaugcuuauguuuuuuaugaauuguuaaauauuucaguauuauauagaaaaaaauagauuuu

SEQ ID NO: 326 - RNA, 62 nt, Human
aaaugcuuuaucuguguuuucuguaaauaaaagagugcaauaauccgggcggugcggguggg

SEQ ID NO: 327 - RNA, 62 nt, Human
aaauggaagaucaaagccuggaugacagcacaucuguuuacagcauggauuacugaauauuu

SEQ ID NO: 328 - RNA, 63 nt, Human
aaauggauaggaccaauaaguuaaauauuaagugugugacuuaugguuaaauaaaaugaaaau

SEQ ID NO: 329 - RNA, 62 nt, Human
aaauggcauuuuauaauauuauguguguacuucacaguguuaaaaauacccucauacguuau

SEQ ID NO: 330 - RNA, 64 nt, Human
aaauggccugggaaguagcagaagcagugcagcaggaacuggaagugccuucauccaggacagg

SEQ ID NO: 331 - RNA, 61 nt, Human
aaaugggagacugcugaggcucuuugcaagagaugagauuaaguuugaguuucuaaggcag

SEQ ID NO: 332 - RNA, 62 nt, Human
aaauguaagugugcuugggaauuccuuaaauuuugugcaauaaacuauuuuuugguaaagau

SEQ ID NO: 333 - RNA, 63 nt, Human
aaauguauauacauuuuagacaaaaaugcacacuccaguauuaauauuugugcuaccaucuac

SEQ ID NO: 334 - RNA, 64 nt, Human
aaauguauuuauuuuauggcaaguuggaaaauauguaacuggaaucucaaaaguucuuugggac

SEQ ID NO: 335 - RNA, 62 nt, Human
aaaugugagauugaacugaacaaacccucaucucaugaaggacgggguguguguguggcguu

SEQ ID NO: 336 - RNA, 64 nt, Human
aaauguggcucaguggagggagacccagcauagccaggccaguauggagcaccucacgcacagc

SEQ ID NO: 337 - RNA, 62 nt, Human
aaauguguagcacagaacugcacuaggauuaauuuguuuacaagaagaaauuuaaacucuac

SEQ ID NO: 338 - RNA, 64 nt, Human
aaauguuagaccacagaaguggaauuugaaaguauaaugcaguacauuaauauucauguucaug

SEQ ID NO: 339 - RNA, 63 nt, Human
aaauuaaaaauauuuaaauccacaauuugauauaacaguauuauuuacauaagaacaaaguuu

SEQ ID NO: 340 - RNA, 62 nt, Human
aaauuaacauuucuuugcugccaugggcugaugaugcugcuauuagauaaaguuuagcugug

SEQ ID NO: 341 - RNA, 61 nt, Human
aaauuaagaauuuugcuuuauuuuaaaccaaauugagauuaaauugaagaaaagcaagcaa

SEQ ID NO: 342 - RNA, 63 nt, Human
aaauuaggaauuggaugcaucauuccuguguguuacaguauuauuuuaauuggccucaauggu

SEQ ID NO: 343 - RNA, 63 nt, Human
aaauuauaaccauuuuugaugcccugaaucuugaggugacuuauuuugcauagaggauaugga

SEQ ID NO: 344 - RNA, 62 nt, Human
aaauuauuucccccaagguagugaaguaauuggaaugaaggaggcugaaaguauugucuaaa

SEQ ID NO: 345 - RNA, 63 nt, Human
aaauuccucgugccugaauaagcacauucagauucacacuggaauaaaaccuuaugaauguaa

SEQ ID NO: 346 - RNA, 62 nt, Human
aaauucuguauaaaacuguaauccuuuguauucauguuuacagugcuauuacuauaauucaa

SEQ ID NO: 347 - RNA, 62 nt, Human
aaauugagccagggucuugcuauguggcucaggcucaucucaaaauccugggcucaagugau

SEQ ID NO: 348 - RNA, 62 nt, Human
aaauuggaaggauucauugagcagcauagaaguuuguuuacauguuacuuugagaugcuagg

SEQ ID NO: 349 - RNA, 62 nt, Human
aaauuguuuugccaacuguauauuuauguaauaagugcaauaaaaugcaguaaauuuuaaaa

SEQ ID NO: 350 - RNA, 64 nt, Human
aaauuuaaaaaaaugugcgagcuaauauggcaaaacaacuggaaggacgcuaaauaauaggauu

SEQ ID NO: 351 - RNA, 63 nt, Human
aaauuuaaaaucuaaaauguaaaauuuugaacacaacacuggaaaggguauccacagcaggaa

SEQ ID NO: 352 - RNA, 62 nt, Human
aaauuuaugaaacuaaaagggugauugacauccauguuuacacuccgcucuaauguuugaua

SEQ ID NO: 353 - RNA, 62 nt, Human
aaauuucuaacaaucaucaguuaggaauauuaacaugaaggauaaaccaacuuauuuguaua

SEQ ID NO: 354 - RNA, 64 nt, Human
aaauuugggacauaaaguuuucaugguagacaguucaugcaguauaugaauugccauaauggaa

SEQ ID NO: 355 - RNA, 64 nt, Human
aaauuuuagaggaaaacaguuauuuugcagcauuacaugcaguacuugugugauguuuugagaa

SEQ ID NO: 356 - RNA, 64 nt, Human
aacaaaaacaaacaaaagcaagaaaaccacaacuaaaacuggaaauguauauuuuguauauuug

SEQ ID NO: 357 - RNA, 62 nt, Human
aacaaaaaguuuaguugaaaaauaucauguaauucaguguuagccaauuuagaaagugaugu

SEQ ID NO: 358 - RNA, 62 nt, Human
aacaaacuacuagugagcgauggcuaagcauccaugcugcuagaauccaaaaagaaucaccc

SEQ ID NO: 359 - RNA, 63 nt, Human
aacaaaggaucuuucaugaauguccaaggguaagucaguauuaauuaaugcuguauuacaagg

SEQ ID NO: 360 - RNA, 64 nt, Human
aacaaaguaucuuaaaaugggaauaauuuuaauauaaugcaguaggugauuaacaaugucucca

SEQ ID NO: 361 - RNA, 61 nt, Human
aacaacaacaacaaaccacaaaauuauuugaguacugugaaggauuauuugucuaacaguu

SEQ ID NO: 362 - RNA, 64 nt, Human
aacaacagcuggacugcuguacaucaaggacagauuaacuggaaaacauauguuccuuaugugu

SEQ ID NO: 363 - RNA, 62 nt, Human
aacaaccagaaacuuuuacuugugauacucuaccaugaaggaugcgguaauggcaggaauag

SEQ ID NO: 364 - RNA, 62 nt, Human
aacaagagauauguuuuugacaauauguguauugugcugcuauagaaauguaaacucuuagg

SEQ ID NO: 365 - RNA, 64 nt, Human
aacaagaggcaacuugucacuuucuuucucaauauuaacuggaaugcugccucuuggguucuca

SEQ ID NO: 366 - RNA, 64 nt, Human
aacaagugggugaaugugguuauggccgaaaaggauaugcaguaugcuuaaugguagcaacuga

SEQ ID NO: 367 - RNA, 63 nt, Human
aacaauauauuuaauucaaguccaauccauguaaucaguauuaagaguguguuuuaccauuca

SEQ ID NO: 368 - RNA, 64 nt, Human
aacacaaacuuuagagcaagaagaccucagacaggaaacuggaauuuuuuaaagugccaaaaca

SEQ ID NO: 369 - RNA, 62 nt, Human
aacacaauuucaaauccuaucuucuagaugcaagcaguguuaaauuuguuaauaaauuugcu

SEQ ID NO: 370 - RNA, 62 nt, Human
aacacucgggaaaugaguaaagaaaauguaaaauugcugcuagucaaaucuuuuggaaagaa

SEQ ID NO: 371 - RNA, 62 nt, Human
aacagaagagcagggacauaaaggaaaaugucaguguuuacaugggaccuauggaaacaaag

SEQ ID NO: 372 - RNA, 61 nt, Human
aacagaagcuuuuuguuugcaucauuuaacugaacugugaacccuugugccucucaucuuu

SEQ ID NO: 373 - RNA, 62 nt, Human
aacagaucuucuucucucuuguccaccuauuaauuguuuacaauauuuguacaucuaugcaa

SEQ ID NO: 374 - RNA, 63 nt, Human
aacaguaucuuacaaaaaacguguugcucucuucacaguauuauguguaaagucauuguuuaa

SEQ ID NO: 375 - RNA, 64 nt, Human
aacagugugggagaauaggaguccagccguaagauaaacuggaaauauuugggcgucuuguacc

SEQ ID NO: 376 - RNA, 64 nt, Human
aacaguuuuauaagguauuugcauuuuagaagcucuggccaguaguuguuaagauguuggcauu

SEQ ID NO: 377 - RNA, 62 nt, Human
aacauacucuuuguauauauuuauuauaugaaaggugcaauauuuuauuuuguacaguaugu

SEQ ID NO: 378 - RNA, 61 nt, Human
aacauaucaaauauaaauuuuuuuaaagaucuaacugugaaaacauacauaccuguacaua

SEQ ID NO: 379 - RNA, 63 nt, Human
aacauauuuaaacuaauauucccuuacaauauggacaguauuaauccuuccaagaugcaguau

SEQ ID NO: 380 - RNA, 55 nt, Human
aacaucaaugggccugugaaaauaagaacugugaacucucaauugaugaggaaau

SEQ ID NO: 381 - RNA, 62 nt, Human
aacaucuacugaauuucuguaauuuaaaauauuuugcugcuaguuaacuaugaacagauaga

SEQ ID NO: 382 - RNA, 64 nt, Human
aacaucuggccgggcuuuuccaagcugccacuggucggccaguacagccuccggaagcagcccu

SEQ ID NO: 383 - RNA, 64 nt, Human
aacaucuucacccuuuaccaggcuuggcauggucugaacuggaaacccugagaauguuucugca

SEQ ID NO: 384 - RNA, 61 nt, Human
aacauguauugagcacagauuuuuuuugguaaaacugugaagagcuaggauauauacuugg

SEQ ID NO: 385 - RNA, 62 nt, Human
aacauguguuucucuuauggauuuuaauaagcuccaguauuauucaaaugaucaaaaauaua

SEQ ID NO: 386 - RNA, 64 nt, Human
aacauuaagcaacuuacauaacucaugcaguaauuucugcaguugggagauguucagcuucagu

SEQ ID NO: 387 - RNA, 62 nt, Human
aacauuagccagggagguucuggcuaacguuaaaugcugcuauacaacugcuuugcaacagu

SEQ ID NO: 388 - RNA, 63 nt, Human
aacauucaccucuuauuuuauauugaaauguauuacaguauuaaaacucaguguucaguauuu

SEQ ID NO: 389 - RNA, 63 nt, Human
aacauucuauuuauaauuccauauagaaaaguuaagugacuuauuuaauaaauguauuauuuu

SEQ ID NO: 390 - RNA, 63 nt, Human
aacauugaaaagacuugccgcacuucugaguccaaacacuggaaagcucuccuuugccaccgu

SEQ ID NO: 391 - RNA, 62 nt, Human
aacauuuaucagaaauuuuaauacucugcauaaccaguauuagcauuagaaauuagccacuu

SEQ ID NO: 392 - RNA, 54 nt, Human
aacauuugacuggcacugauuuugcaauaagcuaagcucagaaacuuuccuacu

SEQ ID NO: 393 - RNA, 59 nt, Human
aacauuugacuggcacugauuuugcaauaagcuaagcucagaaacuuuccuacuguaag

SEQ ID NO: 394 - RNA, 62 nt, Human
aacauuuuaagcuauuuuguugggcuauuucuauugcugcuacagcagaccacaagcacauu

SEQ ID NO: 395 - RNA, 62 nt, Human
aacauuuuacuuuuuaucauugauguguucaaacuguuuacaaggagaugcuuauagaugau

SEQ ID NO: 396 - RNA, 61 nt, Human
aaccaccaugccuacuuguuugcuugcuaccugccugcugacccaccugaccaucucauuu

SEQ ID NO: 397 - RNA, 64 nt, Human
aaccacucuuuccccaccccacccccccaaacccugaacuggaaucaggaaagacggaggaaac

SEQ ID NO: 398 - RNA, 62 nt, Human
aaccacuuaagcauugaaugcggagaaagcagugcuaccucaguuuugcuggaaguagacuu

SEQ ID NO: 399 - RNA, 62 nt, Human
aaccagacugaccacaagaacugucaucucaucaaugaaggaguaacugaucaaugaagcca

SEQ ID NO: 400 - RNA, 62 nt, Human
aaccaugccuuccucaguauccacacauaaacggcaguguuaaaacaugaaugacugugucu

SEQ ID NO: 401 - RNA, 61 nt, Human
aaccauuacccucagcugcugauugggcagcucugagauuagcaaaagccagggacagcua

SEQ ID NO: 402 - RNA, 63 nt, Human
aaccauuguuguuaugaucugcagucuuccuggugacacuggaaucucucucucugccgccuc

SEQ ID NO: 403 - RNA, 64 nt, Human
aacccagaugcccaugagcaagagaguggacaaguaaacuggaauauucacauaauagaacauu

SEQ ID NO: 404 - RNA, 62 nt, Human
aacccagcaguucugagugaguucugagccagcccuaccucaggcuggcuguugagacaugc

SEQ ID NO: 405 - RNA, 62 nt, Human
aacccaggacuaaaaauggacaggcugaccucaguguuuacaaauucagaauuuugauaggg

SEQ ID NO: 406 - RNA, 62 nt, Human
aacccaucuuccgggaagggaggccaggaugccucaguguuaaaaugacaucucaaaagaag

SEQ ID NO: 407 - RNA, 62 nt, Human
aacccugucucagugcauuuuguuuuccugcuuccuaccucaagaucuuggcaaugguacac

SEQ ID NO: 408 - RNA, 61 nt, Human
aacccuuacaugaguaauugaaaugaaauuaaaugagauuacagcauaaugaagaagaaaa

SEQ ID NO: 409 - RNA, 63 nt, Human
aaccgaggacagauucaaauaacaauuaauggauucaguauuagcaauggacuggcaacuacu

SEQ ID NO: 410 - RNA, 62 nt, Human
aaccgcgcaguucauuggccacucugcacgcauucaguauuaccauggagcugggaaucuug

SEQ ID NO: 411 - RNA, 62 nt, Human
aaccgugucagcaugguugccuggcuaccugcucaugaaggacuugauuaauagcaaauugg

SEQ ID NO: 412 - RNA, 64 nt, Human
aaccuaaaauugauuagaaagaaaaguaaaauauuaaugcaguaaauuuaggaugguuacagau

SEQ ID NO: 413 - RNA, 64 nt, Human
aaccuacugggcaugguccucauggaguuuugguucaacuggaaucucugugccaacccaggau

SEQ ID NO: 414 - RNA, 62 nt, Human
aaccucuccccgcagggcaaagccugugcccccaucaucucacuccuuugccugcacugcca

SEQ ID NO: 415 - RNA, 64 nt, Human
aaccucugagagcaacacuugaaucaagugcagcugaacuggaacauaaaagauuuuuucuuaa

SEQ ID NO: 416 - RNA, 61 nt, Human
aaccugcacuuugggaugguagaaguuucuuuaccugcugacagguuugguggcacugcug

SEQ ID NO: 417 - RNA, 61 nt, Human
aaccugcucggaauuaaaggcuuccucugggugccugcugaacaacugagcucaugucaug

SEQ ID NO: 418 - RNA, 62 nt, Human
aaccugggagacggaagaagcacgccaugggaaguguuuacacuuggggacaagugcuaagu

SEQ ID NO: 419 - RNA, 62 nt, Human
aaccuuagauacauagccgacuguauacagagguucaucucaaccucaacacuauugacuuu

SEQ ID NO: 420 - RNA, 62 nt, Human
aaccuuccacugagaagccacuucaagaggcuggugcugcuagaucucaugauguggcuguu

SEQ ID NO: 421 - RNA, 64 nt, Human
aaccuuuggcccagccaucgccgagauucgagggucaacuggaaguggcguuggugcucccugu

SEQ ID NO: 422 - RNA, 62 nt, Human
aacgaaauagauguaggguacaguggaacauaagcaguguuaccccuggcugggagucagua

SEQ ID NO: 423 - RNA, 63 nt, Human
aacgacauuccagaaguuaaucauuugaauucugaacacuggagaaaaaccgaaaaauggacg

SEQ ID NO: 424 - RNA, 61 nt, Human
aacgccauauuuccuuugagggccuucgcccauccugcugacccauuuuucugcccucuuc

SEQ ID NO: 425 - RNA, 62 nt, Human
aacgggaggcuggcagguccucagauagguucugcaguguuaccugucacuuggaggcagcc

SEQ ID NO: 426 - RNA, 62 nt, Human
aacgugcagaaauuuuggagggcugugauuuuuccaguauuaaacaugcaugcauuaaucuu

SEQ ID NO: 427 - RNA, 62 nt, Human
aacuaaggagcaguggcagaaggugggccccguguguuuacagcauuuccagguccagagag

SEQ ID NO: 428 - RNA, 61 nt, Human
aacuagauuagcaaauguuaauuccuagcucaaacugugaauaguaaggauugaaaaguaa

SEQ ID NO: 429 - RNA, 62 nt, Human
aacuagauuaucauaguuaucuaguuuaugagucauaagcuagauuugauucuucaaagaag

SEQ ID NO: 430 - RNA, 62 nt, Human
aacuaggaaauuacuaaguauaaagaagaaaaaccaguauuaauuaagugaugagaccuguu

SEQ ID NO: 431 - RNA, 62 nt, Human
aacuaugagauuuuuaaaaaauggggccgcugaugugcaauaucaaagugaacuugugagua

SEQ ID NO: 432 - RNA, 62 nt, Human
aacuauuugcacacaacagauuuuagauacuuuuugcugcuaguuguguaauauuuauugaa

SEQ ID NO: 433 - RNA, 61 nt, Human
aacucaauuuccacuugaauuuacaaccaaaagccugcugaguugauuacagcugggccaa

SEQ ID NO: 434 - RNA, 61 nt, Human
aacucauggccaaucuuguuuccuauucuucaaccugcugacuucccucuggauucuucug

SEQ ID NO: 435 - RNA, 62 nt, Human
aacucauuuuauucucggcaacaucuggagaagcauaagcuaauuaagggcgaugauuauua

SEQ ID NO: 436 - RNA, 62 nt, Human
aacuccauuauaaucuauauacauuuaaagaccguguuuacauaaucucuucuggguagaaa

SEQ ID NO: 437 - RNA, 62 nt, Human
aacuccuauauaucuuuuauccagauuuacugaguguuuacauuuuaucccauuugccuuau

SEQ ID NO: 438 - RNA, 63 nt, Human
aacuccugaauuuaauuuccccaccuaagucgaaacaguauuaucaaaacacaugugcacaca

SEQ ID NO: 439 - RNA, 61 nt, Human
aacucuauuuuaguacugacaugcauuauuuucacugugaauucacuuuuuuauugcaugu

SEQ ID NO: 440 - RNA, 62 nt, Human
aacucuuggcauuauacgucucccuuuuucuuuacaguauuaguaaaaagaaaaauuguaca

SEQ ID NO: 441 - RNA, 63 nt, Human
aacugaacacaguuuuuacagauauacaauauggagugacuuauauacaaaaugaccuuaaaa

SEQ ID NO: 442 - RNA, 61 nt, Human
aacugauguuuuuauauaguaaacccauuaaauacugugaaaauaacguguaacugauguu

SEQ ID NO: 443 - RNA, 62 nt, Human
aacugcugagauuacagaugugagccaccgcacccuaccucauuuucuguaacaaagcuaag

SEQ ID NO: 444 - RNA, 63 nt, Human
aacuggccuuguucuccuuagcccgucacuccauacaguauuaggugaggauggaugcgggcg

SEQ ID NO: 445 - RNA, 62 nt, Human
aacuggggucuucucuaccgaacuucccaggauuucaucucaccauaucugugugccgcccc

SEQ ID NO: 446 - RNA, 63 nt, Human
aacuggugaccggggcccugggcuggggcugucccacacuggacccagcucucccccugcagc

SEQ ID NO: 447 - RNA, 63 nt, Human
aacugucuccagaacagcaaccacauugaauucuugugacuuaggaaagcuucuuauaguugc

SEQ ID NO: 448 - RNA, 63 nt, Human
aacuguuuagcuuuaaugauauuucuaaauucccagugacuuauuaauaaaaacaggaaaaau

SEQ ID NO: 449 - RNA, 62 nt, Human
aacuuacggaaauacacaaaugcuucucuguaaugugcaauaugcuuugcaacuguagauga

SEQ ID NO: 450 - RNA, 62 nt, Human
aacuuagugauugccacaagaguaggguaccgucuguuuacacguccaguuaggcuacaguu

SEQ ID NO: 451 - RNA, 61 nt, Human
aacuucccacagccacauuucagaccugcugagacugcugagugaggaauggcagugaggu

SEQ ID NO: 452 - RNA, 62 nt, Human
aacuugagaaucccuucuggaaaacccagccuuucaguguuaacaccugcugcaagacaggg

SEQ ID NO: 453 - RNA, 64 nt, Human
aacuugauuucaucauguucauuugauacacaagugaacuggaaagucacuucccauagaagca

SEQ ID NO: 454 - RNA, 62 nt, Human
aacuuggaaucccuaaauucuguaaaaagacaauucaucucauugugaguggaaguaguuau

SEQ ID NO: 455 - RNA, 63 nt, Human
aacuuuaaccaacauuuacguaaguacggucuuugcaguauuacacaauaccgcaugagcuaa

SEQ ID NO: 456 - RNA, 62 nt, Human
aacuuucuuugucaaucuauggacaugcccauauaugaaggagaugggugggucaaaaaggg

SEQ ID NO: 457 - RNA, 62 nt, Human
aacuuuuaagauggauaauagggcauggacugagugcugcuaucuugaaaugugcacaggua

SEQ ID NO: 458 - RNA, 63 nt, Human
aacuuuuauuuuuuaaacaaugggcuaaaaauaaacaguauuaaaagguuaaguuuauauaau

SEQ ID NO: 459 - RNA, 62 nt, Human
aacuuuugguaggaaggaaaacagggaaggugauugcugcuauucuggaauguguccauuga

SEQ ID NO: 460 - RNA, 61 nt, Human
aagaaacaauuaagugguucucaucucuaauuaacugugaaaccauuuaauccaaacaugu

SEQ ID NO: 461 - RNA, 63 nt, Human
aagaaaccacugucucuagaagaaagcuuguuuugcaguauuagugaaucacugaauagcuua

SEQ ID NO: 462 - RNA, 62 nt, Human
aagaaacgugccuuccaucauaaaucaguccauuuguuuacaacuguguuccaagcagguuu

SEQ ID NO: 463 - RNA, 63 nt, Human
aagaaagaugaaauaauaaaacuauuauauaaagggugacuuacauuuuggaaacaacauauu

SEQ ID NO: 464 - RNA, 62 nt, Human
aagaaauggccuguggaauguuauuguucaacguuguuuacagcucuuaaaacauggugagg

SEQ ID NO: 465 - RNA, 64 nt, Human
aagaaauggggccuugcugggaggaacagcauguaaaacuggaacuucuaaccccgucccaaaa

SEQ ID NO: 466 - RNA, 61 nt, Human
aagaacauaggugucuuugugguuuuaaagacaacugugaaauaaaauuguuucaccgccu

SEQ ID NO: 467 - RNA, 64 nt, Human
aagaagaagaaggagagcaagaaggaaagauuugugaacuggaagaaagcaacaaagauugaga

SEQ ID NO: 468 - RNA, 64 nt, Human
aagaagacuucaagggacgauucaaagcucgaccagaacuggaagaacuguuggccaaguugaa

SEQ ID NO: 469 - RNA, 62 nt, Human
aagaagcacucacuuaagcauuccuggagccacccuaccucagggccucuugauauuugagg

SEQ ID NO: 470 - RNA, 61 nt, Human
aagaagccuccaaaucuggaaggugcugaaugcccugcugacugggaaaguuucagggcac

SEQ ID NO: 471 - RNA, 63 nt, Human
aagaagguauuccucaccuuucuugccuuuaccagacacuggaaagagaauacuauauugcuc

SEQ ID NO: 472 - RNA, 62 nt, Human
aagaauaaccaacauauuuauacauuuagaaucauguuuacacuucucucaacuaaaacauc

SEQ ID NO: 473 - RNA, 62 nt, Human
aagaauagucagacugauaaagaagugcuaacagauaagcuauaguuggggaaauuuguggg

SEQ ID NO: 474 - RNA, 63 nt, Human
aagaaucaagagaccugacugccgccaacucacuagugacuuagauacauccccucccccugc

SEQ ID NO: 475 - RNA, 62 nt, Human
aagaaugaccaaaauggccucuaaaagauguuaaucaucucaaaugaccuuuugucuuuggg

SEQ ID NO: 476 - RNA, 62 nt, Human
aagaauguguguggggggauuauuaauuugaaguauaagcuaaauuguuuauuaaaaagccu

SEQ ID NO: 477 - RNA, 64 nt, Human
aagaauguucauaguuacauauuuauaauaguuaauaacuggaaaaagugaaauguaugucugu

SEQ ID NO: 478 - RNA, 64 nt, Human
aagaauuaucuaaucaauuagugaugucugccauggaugcaguagaggaaaguggugguacaag

SEQ ID NO: 479 - RNA, 62 nt, Human
aagaauuggucuuuccuaaaaaugcaacagauaaugcugcuagauuguuauuuuguuugcac

SEQ ID NO: 480 - RNA, 62 nt, Human
aagaccaacucuauggcuaaggucaucugauacacaguguuacauaaugcguacuucaauga

SEQ ID NO: 481 - RNA, 62 nt, Human
aagaccagggaggaaaguggcaagcuguagaaaauguuuacacgcauggaggggcauugcuc

SEQ ID NO: 482 - RNA, 62 nt, Human
aagacgguuaauuacagcccgagaagaacguuaacaguauuaauucuaaccacaaaggagga

SEQ ID NO: 483 - RNA, 61 nt, Human
aagacuacuaugaacaguuuucuuuuaaaauuuugagauuaagaaugccaggaauauuguc

SEQ ID NO: 484 - RNA, 62 nt, Human
aagacuagcaguuaguguuggaaaaaccuggugguguuuacaauguugcuaaucauuacaaa

SEQ ID NO: 485 - RNA, 62 nt, Human
aagacuuauuuuuaagaaaacagguuguguuuggugcugcuaaguucuggccaguuuaucau

SEQ ID NO: 486 - RNA, 64 nt, Human
aagacuucaagauaguuucacuuuaaucaaaagcaaaugcaguaaacaauuugcugcauugcua

SEQ ID NO: 487 - RNA, 62 nt, Human
aagacuugaaaagccuccgccugcuguguggacuucaucucaaggggcccagccuccucugg

SEQ ID NO: 488 - RNA, 61 nt, Human
aagagaaagaggaguuuguuacauuuaaucaacacugugaagucuguucuacagcaauuca

SEQ ID NO: 489 - RNA, 62 nt, Human
aagagaacaagaaaaguacaacauugcuuaaguccuaccucaucuuuauuuuuuuacagaug

SEQ ID NO: 490 - RNA, 61 nt, Human
aagagacaaguuuaucacaguauuuuuuuuuccccugcugacccauugcuguaccaacgau

SEQ ID NO: 491 - RNA, 62 nt, Human
aagagacuguggcucucuguugugagaucuucagcuaccucauggugcaauaacacacacac

SEQ ID NO: 492 - RNA, 62 nt, Human
aagagacuuugaagucaccugacucagccccuuguguuuacagacaaggacauguaguccaa

SEQ ID NO: 493 - RNA, 62 nt, Human
aagagauccgaaucugugcccagcgcuaaaggcucaguguuagcauggcuugugcuggccgg

SEQ ID NO: 494 - RNA, 63 nt, Human
aagagcaacaguauuccucaauccugucuguucugcaguauuaagcuaagaacagguaaaaca

SEQ ID NO: 495 - RNA, 62 nt, Human
aagagcuacuucauucuuuucugaaguuguguguugcugcuagaaauagucauuugugaauu

SEQ ID NO: 496 - RNA, 64 nt, Human
aagaggaaggggacugcguuaacgguuacuaaggaaaacuggaaauacugucugguuuuuguaa

SEQ ID NO: 497 - RNA, 62 nt, Human
aagaggaguggggguugggggcgcuccuuucuguuuccguuaggccacagacucuucaccug

SEQ ID NO: 498 - RNA, 62 nt, Human
aagaggguaacauggguuaccuuugcaccagcuucaguguuaagcucacccuguucuuugaa

SEQ ID NO: 499 - RNA, 62 nt, Human
aagaggguuugcauuuuggauuaauucaugcaaaaugaaggaggaagccuggucuaagaaga

SEQ ID NO: 500 - RNA, 64 nt, Human
aagaguacugacauuuagaguuguuuaaaggccgagaacuggaaacagccuuucccucauuuuc

SEQ ID NO: 501 - RNA, 62 nt, Human
aagauaaaauuacauaguauuaccuagacauagacaguauuaccuagguagaugcacugcuc

SEQ ID NO: 502 - RNA, 62 nt, Human
aagauaaaauuuaguugaguuuuuaauguuuacauguuuacaucucuaaauaaaauuugcuu

SEQ ID NO: 503 - RNA, 62 nt, Human
aagauaccuaagcacuagaauauccagcuaaauggugcaauaggcuaggaauugagccagga

SEQ ID NO: 504 - RNA, 62 nt, Human
aagaucaaguguaucugaacucucagguugugagugcugcuauuggacccaaaaggaacgug

SEQ ID NO: 505 - RNA, 63 nt, Human
aagaugaaagugcagcaaagcaaugaaaaaugauaacacuggaagugaaauuuuaaucaaaca

SEQ ID NO: 506 - RNA, 61 nt, Human
aagaugacaaguuagggagagaucagaggucauacugugaagcaccuuuggauaaacggca

SEQ ID NO: 507 - RNA, 62 nt, Human
aagaugacacguggugauugugaagaugguaauuugcugcuaauagaguccucaaaggguua

SEQ ID NO: 508 - RNA, 62 nt, Human
aagaugagaacucccuaagaguucucauaauaaaucaucucaucacaaaucaauacgguaua

SEQ ID NO: 509 - RNA, 62 nt, Human
aagauggaccugcucuuauacuguugauuacuuucaguauuaauauacuauuccccaauuau

SEQ ID NO: 510 - RNA, 61 nt, Human
aagauucaccuccucucaccaaauauuuaacuaccugcugaauacgccucuguacuaggca

SEQ ID NO: 511 - RNA, 64 nt, Human
aagauucccagagacaggaaaauccucuggcuggcuaacuggaagcauguaggagaauccaagc

SEQ ID NO: 512 - RNA, 62 nt, Human
aagauugcuuuuuuuuuuuuuuuaacuguaguuccaguauuauaugaugacuauugauuucc

SEQ ID NO: 513 - RNA, 64 nt, Human
aagauuuagggacauaaaaugaucuugcaggucguaaacuggaaaacaguauuuugguugucuu

SEQ ID NO: 514 - RNA, 63 nt, Human
aagcaaaacaagugagaacaggaaaaaggaagaggacacuggaaucaauucuugagaguugca

SEQ ID NO: 515 - RNA, 62 nt, Human
aagcaaacaacaauaucaacaacaagagauugaaauaagcuauggguaaaauaaugccagua

SEQ ID NO: 516 - RNA, 62 nt, Human
aagcaagaugccauuuuccccaugacuuugguuuuguuuacauuuuucccuuucaguuagua

SEQ ID NO: 517 - RNA, 62 nt, Human
aagcaagcaacuugcaggcuccauggaacuuuuaaugaaggacagugucuucuuugaagaaa

SEQ ID NO: 518 - RNA, 61 nt, Human
aagcaauccuaccaccuuggccucccaaagugcugagauuacaggcaugagccauugcacc

SEQ ID NO: 519 - RNA, 61 nt, Human
aagcaauccuccugccucagccucccaaagugcugagauuacaggugugagccaccaggcu

SEQ ID NO: 520 - RNA, 61 nt, Human
aagcaaucugcccacgucggccucccaaagugcugagauuauaggcgugagccaccgugcc

SEQ ID NO: 521 - RNA, 61 nt, Human
aagcaaugcuucugccucagcuucccaaguagcugagauuacaggcgcacaccaccacgcc

SEQ ID NO: 522 - RNA, 61 nt, Human
aagcaauucuccugccucagccuacugaguagcugagauuacaggugcacaccaccacguc

SEQ ID NO: 523 - RNA, 61 nt, Human
aagcaauucuccugccucagccucccgaguagcugagauuacaggcgcccaccaccacgcc

SEQ ID NO: 524 - RNA, 61 nt, Human
aagcaauucuccugccucagccuccugaguagcugagauuacaggagccugccaccacacc

SEQ ID NO: 525 - RNA, 61 nt, Human
aagcaauucuccuucuucagccucccgaguagcugagauuauaggcgugcaccaccacacc

SEQ ID NO: 526 - RNA, 61 nt, Human
aagcaauucuuccaccucagccucccaaagugcugagauuacuggcuugagccacugcacc

SEQ ID NO: 527 - RNA, 63 nt, Human
aagcacacaaguauuuugggaaaaaauccuaaaaggugacuuaauuugaugccuuaaauucac

SEQ ID NO: 528 - RNA, 62 nt, Human
aagcacaucguccuguuuuauugcuuucuacccugugcaauauuagcaugcaagcuuggcuu

SEQ ID NO: 529 - RNA, 61 nt, Human
aagcacauuuguuccuuuauaucuguuuacaaaacugugaaucaaaaagacaaaacuuucu

SEQ ID NO: 530 - RNA, 55 nt, Human
aagcaccacaaagcaaugaaaucauuaucaucucaacaugcccccaauuucucuc

SEQ ID NO: 531 - RNA, 64 nt, Human
aagcagaggcauccuugagcuuuaaagcauugaacaaacuggaaaaugcaacauaccacauaac

SEQ ID NO: 532 - RNA, 62 nt, Human
aagcaucccgucaaaggcagaaucugucacuugaaugaaggaaagcuuaaagcccaagcaga

SEQ ID NO: 533 - RNA, 62 nt, Human
aagcaugcccaagacuauguccugacauauaacuaugaaggaagaggaucgguggcuggguc

SEQ ID NO: 534 - RNA, 62 nt, Human
aagcauggauguugauggcuaacuucugcggcauauaagcuacagaucucaaguuacuucuc

SEQ ID NO: 535 - RNA, 61 nt, Human
aagccaucugccugccuccaccucccaaaaugcugagauuacaggugugagccaccaugcc

SEQ ID NO: 536 - RNA, 61 nt, Human
aagcgaucauuucgccucagccucccaaagugcugagauuauaggugugagccacagcauc

SEQ ID NO: 537 - RNA, 61 nt, Human
aagcgauucuccuaccucagccuccucaguagcugagauuacaggcaugcaccaccaugcc

SEQ ID NO: 538 - RNA, 61 nt, Human
aagcgauucuccugccucagccucccgaguagcugagauuacaggugcgcgccaccacacu

SEQ ID NO: 539 - RNA, 61 nt, Human
aagcgauucuccugccucagccuccugaguagcugagauuacaggcauguaccgcuaugcc

SEQ ID NO: 540 - RNA, 61 nt, Human
aagcgugugugaacaaauggaaauaaagcagggacugugaacauuccugcccgcauccucc

SEQ ID NO: 541 - RNA, 61 nt, Human
aagcguuugggcugguagacccaccccuuccuaccugcugagugaugucauuuccugccag

SEQ ID NO: 542 - RNA, 62 nt, Human
aagcuccuugaaaauccaggcggguauggaaaggugcugcuacccauaucuuuuugacuuuc

SEQ ID NO: 543 - RNA, 64 nt, Human
aagcuccuuuucucauuucaaaguugcuaccaguguaugcaguaauuagaacaaagaagaaaca

SEQ ID NO: 544 - RNA, 61 nt, Human
aagcugacacaggccucacugcaauuugauaugccugcugaucagagucucuugggcauuu

SEQ ID NO: 545 - RNA, 62 nt, Human
aagcuguuagccuuagagugauugcagugaacacuguuuacacaccgugaauccauucccau

SEQ ID NO: 546 - RNA, 63 nt, Human
aagcuucguacaaaugugaaguauuaauauuaucgcaguauuauuguuguuauuauuauuguu

SEQ ID NO: 547 - RNA, 62 nt, Human
aagcuuuuggaaaagcuccagguccucauguauugugcaauaacaaugacuuccuuggcggu

SEQ ID NO: 548 - RNA, 64 nt, Human
aaggaaaaaacauacccuuggguacccauagccaauaacuggaagaaaaugaugugaauuucau

SEQ ID NO: 549 - RNA, 64 nt, Human
aaggaaaaaggugaauauguuuuuguaugaauguuuaacuggaaauguccauggacuuggcuaa

SEQ ID NO: 550 - RNA, 64 nt, Human
aaggaaaaguuuggcuacuaacaguagcauugugauggccaguauauccaguccauggauaaag

SEQ ID NO: 551 - RNA, 61 nt, Human
aaggaaaauauaccuuaacuuuuuuucuuuuacacugugaaacauacacaguagaaauucu

SEQ ID NO: 552 - RNA, 62 nt, Human
aaggaacaaaacgagcaugaauuaacucuucaauauaagcuaugaaguaauaguugguugug

SEQ ID NO: 553 - RNA, 61 nt, Human
aaggaagccauugcacugugaacacuguaccugccugcugaacagccugcccccguccauc

SEQ ID NO: 554 - RNA, 62 nt, Human
aaggaagccccuuuggggcagggaggugaggacuucaucucaacaucggcuggugguuggua

SEQ ID NO: 555 - RNA, 61 nt, Human
aaggaaggagggcacauuaacucccuccaccagccugcugacagacacuaacuuuguaucc

SEQ ID NO: 556 - RNA, 62 nt, Human
aaggaauccaagugccuuucuguagccuccagaugugcaauaacgguaacuugacucuucca

SEQ ID NO: 557 - RNA, 62 nt, Human
aaggacacuguuugauauacagcagguauucaaucaguguuauuugaaaccaaaucugaauu

SEQ ID NO: 558 - RNA, 62 nt, Human
aaggacauuugggagagggaugcccaggaacgccucaucucagcagccugggcucggcauuc

SEQ ID NO: 559 - RNA, 63 nt, Human
aaggacugauacaaagaaagugcaugaggcaaugucaguauuaucugacaucuuucuuuucag

SEQ ID NO: 560 - RNA, 62 nt, Human
aaggacuuucauuuucuuuagaaucauuugcuacuguuuacacaggugaagauuaaacaccc

SEQ ID NO: 561 - RNA, 62 nt, Human
aaggagcaugguuuggugguuaagguuuagugggaugaaggaccugucuuggugggccgggc

SEQ ID NO: 562 - RNA, 62 nt, Human
aaggagucacaguauuuauaaccauuuugagcuaauaagcuauaccucacucucugcuuucu

SEQ ID NO: 563 - RNA, 64 nt, Human
aaggagugcagggaggggcaggaaaggagacaaggaggccaguauggacacuguguccaguaug

SEQ ID NO: 564 - RNA, 62 nt, Human
aaggauaaagaucuauacaugaacagcagaauguauaagcuagcauuuacuagcaugucucu

SEQ ID NO: 565 - RNA, 61 nt, Human
aaggaugguagggauuuuuucuuuguugaauauacugugaauuuugggauucuggaguccu

SEQ ID NO: 566 - RNA, 63 nt, Human
aaggauuagaaaacucuaaaguucugacuucaaucaacgguuagugugauacugccaaagaac

SEQ ID NO: 567 - RNA, 64 nt, Human
aaggcacuuguuauaaaugaaaguucuggcucuagaggccaguacucuggaguuucagagcagc

SEQ ID NO: 568 - RNA, 62 nt, Human
aaggccaccuuuauccuuuuugaugccauauuuucaguguuacacuuuuauggcuuuuaauu

SEQ ID NO: 569 - RNA, 62 nt, Human
aaggcccauaucugugaaaugcuggcauuugcaccuaccucacagagugcauugugaggguu

SEQ ID NO: 570 - RNA, 63 nt, Human
aaggccccugcaauguggugacaccucccccuuucacacuggauccaucuugagccacaguca

SEQ ID NO: 571 - RNA, 61 nt, Human
aaggccucuucaguauaaggaaauaccuggaaaacugugaaacuuuuaccacgacguaauc

SEQ ID NO: 572 - RNA, 61 nt, Human
aaggcuguaauuggagcagcuuuuggcugcguaacugugaacuauggccauauauaauuuu

SEQ ID NO: 573 - RNA, 62 nt, Human
aagggaaggcucccugggaccuuagacacccagcucaucucagcggggucuggacucaccuu

SEQ ID NO: 574 - RNA, 62 nt, Human
aagggauggaaaaggaagacuagaggcuugcauaauaagcuaaagaggcugaaagaggccaa

SEQ ID NO: 575 - RNA, 61 nt, Human
aagggauucuccugccucagccucccgaguaccugagauuacaggcacccaccaccacacc

SEQ ID NO: 576 - RNA, 62 nt, Human
aagggcccccugagguguggucgcugccaagcaucaguguuagggcuggggcucagccuggg

SEQ ID NO: 577 - RNA, 62 nt, Human
aaggggacagguagguggcuggagggacccuuuuugcugcuagaaagccccucccuucuccc

SEQ ID NO: 578 - RNA, 61 nt, Human
aaggggaggcagaucucaaacuccaggcucagaacugugaagacuguuuccagccuggcug

SEQ ID NO: 579 - RNA, 61 nt, Human
aaggggaggggugcuggagauuagauuagacaaugagauuaagagaacuccaaauagccca

SEQ ID NO: 580 - RNA, 61 nt, Human
aagggugaauaguuuccuaaugguuaaaaaccaacugugaaaggaaccaccugugugguug

SEQ ID NO: 581 - RNA, 62 nt, Human
aagggugcacaagagcuuacuucacccugaaaaucaguauuauuaaugaaaaguacuguuuu

SEQ ID NO: 582 - RNA, 63 nt, Human
aagggugcccagcacguggccccagaccaaucugagugacuuaguguuggcaaggucccggga

SEQ ID NO: 583 - RNA, 62 nt, Human
aagguagguguuugauuagaacacauuuaaacaucaguauuaugaaaacuuguacuuuuugc

SEQ ID NO: 584 - RNA, 63 nt, Human
aaggugccuaacacgagguauacaguauguucaguacacuggaauagcaugcucgauuggaaa

SEQ ID NO: 585 - RNA, 62 nt, Human
aaggugggcuuuaaaaccuuaaaaaccuaggacaaugaaggaguccaaucccuuggcagauc

SEQ ID NO: 586 - RNA, 64 nt, Human
aagguuauuauaauaaauuauauuaguaaaagucuuaacuggaaaaaagaaucuaaaucagaau

SEQ ID NO: 587 - RNA, 61 nt, Human
aagguucccccgcugagaucuuuccuccugguuacugugaagccuguugguuugcugcugu

SEQ ID NO: 588 - RNA, 63 nt, Human
aagguuggcauucaauaaggaaaaaguucuaacuccaguauuaaauuguacauaaaucccaaa

SEQ ID NO: 589 - RNA, 63 nt, Human
aagguugguuacuauaauaccccucaguaagauuccaguauuaauuucugggcaguuuguucu

SEQ ID NO: 590 - RNA, 62 nt, Human
aagguuuggcagaacuaaaaacaaaacucacguaucaucucaauagauacagaaaaggcuuu

SEQ ID NO: 591 - RNA, 64 nt, Human
aaguaaaagguggcuggaacaucuauuuuucuacaaaacuggaaaaaugaaccugguucuagaa

SEQ ID NO: 592 - RNA, 64 nt, Human
aaguaaaaucuuucuugugcauuuucaauacuuguaaacuggaaaucagaaaauauuuacuaug

SEQ ID NO: 593 - RNA, 63 nt, Human
aaguaaaguaaacauuaucgcuaaguguacuugugcaguauuaacagcuacauuauacaguaa

SEQ ID NO: 594 - RNA, 62 nt, Human
aaguaaugguucucauagugguauaaaguucacacaguauuaugacacucccagcguaucau

SEQ ID NO: 595 - RNA, 62 nt, Human
aaguaauuugaucguuugcugccagcccagaaggaugaaggaaagaagcaccucacagcucc

SEQ ID NO: 596 - RNA, 62 nt, Human
aaguacaagugugugauguuagaaccucccuaguugcugcuauaucaaacacugcacacuug

SEQ ID NO: 597 - RNA, 62 nt, Human
aaguacagugcaacauauacaaauugacugagugcaguauuagauuucaugggagcagccuc

SEQ ID NO: 598 - RNA, 64 nt, Human
aaguacagugugugucggagagauguaccacagcuuaacuggaagaggaagcccguaacugcug

SEQ ID NO: 599 - RNA, 63 nt, Human
aaguacccaauggcaucucuccaucuacaaaguugcaguauuaugcaaauaaaacugaccuca

SEQ ID NO: 600 - RNA, 63 nt, Human
aaguagccaugcuuugguuguguguuuggccuuuucaguauuagacaaucauucuacaagagc

SEQ ID NO: 601 - RNA, 64 nt, Human
aaguauagguaguauaguagugauuguucuucaagcaugcaguaaagaucacuuuuuuuuuuuu

SEQ ID NO: 602 - RNA, 62 nt, Human
aaguaucuacuucuaaaauuaccuaguugaaaauaugaaggauaugcuuaguuuuagaaaua

SEQ ID NO: 603 - RNA, 62 nt, Human
aaguauggaugauagaaaaauguaucagguuuauucaucucaucuuucuguuacaggaugau

SEQ ID NO: 604 - RNA, 62 nt, Human
aaguauuaauacuuuaaagucaaauaagauauaguguuuacauucuuuagguccugaggggc

SEQ ID NO: 605 - RNA, 63 nt, Human
aaguauuauccacuggucagauggucaacuuuuuucaguauuauuuauaguuggcacuugauu

SEQ ID NO: 606 - RNA, 61 nt, Human
aaguauugacgugcccaccauucauuucaguacacugugaaaaugcacaaagaaaguaucc

SEQ ID NO: 607 - RNA, 61 nt, Human
aaguauuuuuuuuuugucuuuagcaaaguuuagacugugaauaugaugacacagauucuuu

SEQ ID NO: 608 - RNA, 62 nt, Human
aagucaaauguguauguucuaccuccaacggaaauguuuacaaggucaagacuuaauucaau

SEQ ID NO: 609 - RNA, 61 nt, Human
aagucagcuuggagaggagaucaugaucuuuauacugugaauagcagaaugucacagauga

SEQ ID NO: 610 - RNA, 61 nt, Human
aagucagucagucugggacuuccagccucuagaacugugaaacaauaaauuucuguggugu

SEQ ID NO: 611 - RNA, 62 nt, Human
aagucaguuauuagauuuaaaucaccuucugaaaugcugcuauagggcugguaucuguaaaa

SEQ ID NO: 612 - RNA, 61 nt, Human
aagucauccgcccaccucgaccucccaaagugcugagauuacaggcaugagccaccaugcc

SEQ ID NO: 613 - RNA, 62 nt, Human
aagucauguauaagauguuuucuaaaagacuuuucaguauuacaacuaauacuauuauuauc

SEQ ID NO: 614 - RNA, 61 nt, Human
aaguccaaacuacagguaaaaacuacggcuuguacugugaaaaaugugcagcuuuucaguu

SEQ ID NO: 615 - RNA, 62 nt, Human
aaguccaaaguauaaacaugcuccuuuccucucuugcugcuacucuugcuuuuggaaguuac

SEQ ID NO: 616 - RNA, 62 nt, Human
aaguccacugaaagucucuaaggaaguauccucuugcugcuaaacuugguacaaguugacua

SEQ ID NO: 617 - RNA, 62 nt, Human
aagucccagcugaauucuugcccuuaagugcuuuugcugcuauuuuuuugcccccaguucca

SEQ ID NO: 618 - RNA, 64 nt, Human
aaguccguaucaucuggcauuuuaucaagacucagcaacuggaauguuaaacuaaagaggggga

SEQ ID NO: 619 - RNA, 64 nt, Human
aaguccuccugauucuguaucacaugagacaccaaaaacuggaaauguagucacacccaguaca

SEQ ID NO: 620 - RNA, 62 nt, Human
aagucugucuaauggagaguuuuuuuuaaacugucuaccucauauaauacaaguauuuacaa

SEQ ID NO: 621 - RNA, 63 nt, Human
aagucuugcucaaauguuauuaugagguacuaugagugacuuacauguguuuuaaaaugucag

SEQ ID NO: 622 - RNA, 61 nt, Human
aagugaauacagggugacugagugaucaucagaugagauuaauucuuuuggguuuucuugg

SEQ ID NO: 623 - RNA, 61 nt, Human
aagugauccacccgccucagucucccaaagugcugagauuacaggcaugagucacuacgcc

SEQ ID NO: 624 - RNA, 61 nt, Human
aagugauccacccgccucggccucccacagugcugagauuacaggugggagccacugcacc

SEQ ID NO: 625 - RNA, 61 nt, Human
aagugauccaccuuccuugugcucccaaagugcugagauuacaggcgugagcuaucacacc

SEQ ID NO: 626 - RNA, 61 nt, Human
aagugaucccccugccuuggccucccaaacuggugagauuacaggcaugagccaccacaac

SEQ ID NO: 627 - RNA, 61 nt, Human
aagugauccucccgucucagccucccaaagggcugagauuacaggugugagcuaccucacc

SEQ ID NO: 628 - RNA, 61 nt, Human
aagugauccuccugccucagccucccgaguaccugagauuagcccagguaauuuaagaauu

SEQ ID NO: 629 - RNA, 61 nt, Human
aagugauccuccugucuuggccucccaaagugcugagauuacaggugugagccacugugcc

SEQ ID NO: 630 - RNA, 61 nt, Human
aagugaucggcccaccuugucaucccaaagugcugagauuacagcauuggcgcucucauag

SEQ ID NO: 631 - RNA, 61 nt, Human
aagugaucugcccaccucagccucccaaagugcugagauuacaggcaugagccacugcacu

SEQ ID NO: 632 - RNA, 61 nt, Human
aagugaucugcccgccucggccucccaaagugcugagauuacaggcaugacccaccgcguc

SEQ ID NO: 633 - RNA, 61 nt, Human
aagugaucugucuaccucggccuccuaaagugcugagauuacaggugugagccaccgugcc

SEQ ID NO: 634 - RNA, 61 nt, Human
aagugaucuuccugccucagccucccaaaaugcugagauuacaggcaugagccacuguacc

SEQ ID NO: 635 - RNA, 61 nt, Human
aagugauucuccuaccucagccucccaaggagcugagauuacgaguacaccacaccaugcc

SEQ ID NO: 636 - RNA, 61 nt, Human
aagugauucuccucccucagccucccaagcagcugagauuacaggugcaugccaccacugc

SEQ ID NO: 637 - RNA, 61 nt, Human
aagugauucuccugccacagccuccugaguaccugagauuacaggcacccaccaccaugcc

SEQ ID NO: 638 - RNA, 61 nt, Human
aagugauucuccugccucauccucccaagaagcugagauuacagaugaccaccaccacucc

SEQ ID NO: 639 - RNA, 62 nt, Human
aagugcugaauuacaaugugaaguuaaugacuucuguuuacaaaugagacacucuaacgagu

SEQ ID NO: 640 - RNA, 61 nt, Human
aagugcugccuuaguugcuaguuuaguagccuuacugugaaggaauaauuaagauuguuuc

SEQ ID NO: 641 - RNA, 64 nt, Human
aaguggauuguauugugagauccugugauuccugguggccaguauccuggauuccucuaagauc

SEQ ID NO: 642 - RNA, 63 nt, Human
aagugguagggacaagcagugaggugguggccaugacacuggagaccaagccucagcggaggg

SEQ ID NO: 643 - RNA, 62 nt, Human
aaguuaauauacuaaaggguuccuuuuuuuuuaauguuuacauuuaucucuauguuuaccuu

SEQ ID NO: 644 - RNA, 62 nt, Human
aaguuaccuuaauaguccucuuguguuauuaggacaguauuauuauaguacuuauuuauuuu

SEQ ID NO: 645 - RNA, 61 nt, Human
aaguuagauuacuagacagauauaaacagauccccugcugaacagauacacagaguucuca

SEQ ID NO: 646 - RNA, 62 nt, Human
aaguucauuauaagggcuuuauucaugccugauuuguuuacaugaggacuucugaaauuaau

SEQ ID NO: 647 - RNA, 62 nt, Human
aaguucugcuguaccuccaguggaugcuguuucucaguauuaugacaugugacaggugaacu

SEQ ID NO: 648 - RNA, 62 nt, Human
aaguugcguugaggccgcaucuuucuucagcagcgugcaauagcuggcuccucuauaggaga

SEQ ID NO: 649 - RNA, 62 nt, Human
aaguuguuggauguuuccucuuccucccuuaugucuaccucaccaaccucgcucaucauuug

SEQ ID NO: 650 - RNA, 62 nt, Human
aaguuuagucucuggcgugaaauuuuaaucaccaaugaaggagagaggcaccuguagguaaa

SEQ ID NO: 651 - RNA, 61 nt, Human
aaguuuaucucucuuucuaguaaaauggugcuuacugugaauggauaaucuuuuuuuucau

SEQ ID NO: 652 - RNA, 63 nt, Human
aaguuucaagcaacuccaaaauugaaugugacaaacaguauuaaaccuuaagccucaagacgu

SEQ ID NO: 653 - RNA, 63 nt, Human
aaguuugaguuaggagcuuuuaccuuguagcagagcaguauuaacaccuaguugguucaccug

SEQ ID NO: 654 - RNA, 62 nt, Human
aaguuugccaaccauaagugucaaaagcacaggccaguauuaagcagaaguucuaccaccuu

SEQ ID NO: 655 - RNA, 62 nt, Human
aaguuugguuuuugaauagacagagguuucauuuucaucucauuagggcuuuuuuguacaua

SEQ ID NO: 656 - RNA, 64 nt, Human
aaguuuguagauuuucauaagccacaauuuuaaaagaugcaguaaucuuccaacuuccaauauu

SEQ ID NO: 657 - RNA, 62 nt, Human
aaguuuuuaaauguaucugaacuugcuguuaacacaguguuauaacucaagcacuagcuuca

SEQ ID NO: 658 - RNA, 61 nt, Human
aaguuuuuuuaucucuuuuuuuuaaaacaacauacugugaacuuuguaaggaaauauuuau

SEQ ID NO: 659 - RNA, 62 nt, Human
aaguuuuuuugcuuaauuaugaaguagacaugcauguuuacauuuauguaaaauauuugcug

SEQ ID NO: 660 - RNA, 62 nt, Human
aauaaagucucauuggaacacagccaugcucauuuguuuacauguuguuuauggcgacugcc

SEQ ID NO: 661 - RNA, 64 nt, Human
aauaaauaauauaauugguguagcacagugccuugcaugcaguaggcagccaacaaauccuuaa

SEQ ID NO: 662 - RNA, 61 nt, Human
aauaaaugauguaucaggguauuuguauugcaaacugugaaucaaaggcuucacagcccca

SEQ ID NO: 663 - RNA, 64 nt, Human
aauaacaagggucagauuuccucuccugccuuaaacaacuggaagcuauacaauacguauaaua

SEQ ID NO: 664 - RNA, 62 nt, Human
aauaacguuuuauuggagcauagcuguacccauuuguuuacauauuggcuauggcugcuguc

SEQ ID NO: 665 - RNA, 62 nt, Human
aauaacuccagauuucauaauuccaguuuuuacauuccguuaucuuucugguacaaccauuc

SEQ ID NO: 666 - RNA, 63 nt, Human
aauaagcucaaguuuauguacucugaguuuuuaaaacacuggagugauguugcugaccagccg

SEQ ID NO: 667 - RNA, 63 nt, Human
aauaaucaaaacaccgcguaggcuccuccguuuaucaguauuaaugguguaacuuuguuggca

SEQ ID NO: 668 - RNA, 61 nt, Human
aauaaucuccuugaggcaucuuuauuuuuaaaaugagauuaaaguaugugauuugcuuguu

SEQ ID NO: 669 - RNA, 62 nt, Human
aauaauggcagccuugauuucauagguuuguccccaguguuagcuuaauaucuggcaugugg

SEQ ID NO: 670 - RNA, 62 nt, Human
aauaauggcaguacuaagagauuuauaaucauaauguuuacaaugcagccuacuggauuguc

SEQ ID NO: 671 - RNA, 62 nt, Human
aauaaugugauccuaaaacuggcuuauccuugaguguuuacaacucaaacaacuuuuugaau

SEQ ID NO: 672 - RNA, 62 nt, Human
aauaauucuggauuuucuuaucacaaaaaagaaaaugaaggaccucaaagcaccugaacagu

SEQ ID NO: 673 - RNA, 62 nt, Human
aauaauucuucaagauccaaaagaaaaaaauauacuaccucagauuuucaagaaggugaacu

SEQ ID NO: 674 - RNA, 62 nt, Human
aauaauugauuuaguuuugugcuaaugauaaugaugcugcuacugauaauaauaauaacaau

SEQ ID NO: 675 - RNA, 62 nt, Human
aauaauuuggaauuuuaagauacugguguaaaaguguuuacagaaacaucuuuguucaaaga

SEQ ID NO: 676 - RNA, 62 nt, Human
aauacaaguggccaauagcacauaagaagaugcccaguauuacagccaagaggaaaaugcaa

SEQ ID NO: 677 - RNA, 62 nt, Human
aauacaccaauuaaaauauuucuacauaugagaauguuuacaauuuaaauuuuagaacuugu

SEQ ID NO: 678 - RNA, 62 nt, Human
aauacacuuaaaauacugcaggaugcuuagugcucaguguuauguaugaacuuguggacuuu

SEQ ID NO: 679 - RNA, 62 nt, Human
aauaccugaaacuguggauuauauugcuugacuucuaccucagaaucuucuuuguuucauga

SEQ ID NO: 680 - RNA, 62 nt, Human
aauagacuccugggauggggcagccaacccuggcucaucucaucugccgcuuggugcgugug

SEQ ID NO: 681 - RNA, 61 nt, Human
aauagagucuggacaaugcuggauguaaagaaaacugugaagcuaccucuaagcauauugu

SEQ ID NO: 682 - RNA, 64 nt, Human
aauagauauuucugauuugaaaauucuaaagaauuaaacuggaaaaguauuucauuuacuuagu

SEQ ID NO: 683 - RNA, 62 nt, Human
aauagaugagacugacaacgucugaacccacucaucaucucaacuucacaaaaagcaagaga

SEQ ID NO: 684 - RNA, 62 nt, Human
aauagcugcaucuguguaauccagaauaaucucuucaucucaagguuuuuguucuguuuugu

SEQ ID NO: 685 - RNA, 64 nt, Human
aauagugccacuaacgguugaguuuugacugcuuggaacuggaauccuuucagcaagacuucuc

SEQ ID NO: 686 - RNA, 63 nt, Human
aauaguuccucccucuguuccugacccccucacacacacuggaaagugagggugggggcucug

SEQ ID NO: 687 - RNA, 62 nt, Human
aauaguucuggccagaccccguuccccuuccucuaugaaggaauaaguuggaccaagggaag

SEQ ID NO: 688 - RNA, 62 nt, Human
aauauauuuugaccuuaccauuauuccagagauucaguauuaaaaaaaaaaaaauuacacug

SEQ ID NO: 689 - RNA, 62 nt, Human
aauaucgacagggcuacacgugauguccccaaacugcugcuauugaagaacuucccaaaacu

SEQ ID NO: 690 - RNA, 62 nt, Human
aauaucuucuuuuaccuaucaauauucauugaacugcugcuacauccagacacugugcaaau

SEQ ID NO: 691 - RNA, 64 nt, Human
aauaugcaguacauuauccaaaagagaagguaguuaaugcaguagaaaguagugguaauaauuc

SEQ ID NO: 692 - RNA, 63 nt, Human
aauaugcuuugauugaugcagcauuaugcuuugggcaguauuacaaaauagcuggcgagugcu

SEQ ID NO: 693 - RNA, 63 nt, Human
aauauguuggaaaacagcuguauacauuuuugggcaacgguuaugcauaauauuuaccaggag

SEQ ID NO: 694 - RNA, 62 nt, Human
aauauuaaagauucucuuuaaaaaagacugaacauguuuacagguuugaauuaggcuaaaag

SEQ ID NO: 695 - RNA, 62 nt, Human
aauauuaaauucaaauaucccauaucuaaauuuagugcaauaucuugucuuuuguauagguc

SEQ ID NO: 696 - RNA, 61 nt, Human
aauauuaauuaaaauggucuguaaacaauaacaacugugaauaagauuaucaaaucuguuu

SEQ ID NO: 697 - RNA, 62 nt, Human
aauauuaugcagaugccguuaauuuuuuacccuauguuuacaucuugaggcagcagagucug

SEQ ID NO: 698 - RNA, 64 nt, Human
aauauucauguauguuaaacuuuucugauugaggcuaacuggaaaaagcuggggucguauucua

SEQ ID NO: 699 - RNA, 64 nt, Human
aauauuccaaaugucuuuuagaagauagaugcacuuaugcaguaaauuaucuugggauaguucc

SEQ ID NO: 700 - RNA, 64 nt, Human
aauauuuauuuauugagaguuuuuuagugcaaucugggccaguauuuuuauagauuaugauuau

SEQ ID NO: 701 - RNA, 62 nt, Human
aauauuugcaagacauagaauaguguuggaaaaugugcaauaugugauguggcaaaucucua

SEQ ID NO: 702 - RNA, 61 nt, Human
aauauuuguuucuuuuuagaacauuuuauuuauacugugaagacuuuguuauaccuuauuu

SEQ ID NO: 703 - RNA, 62 nt, Human
aauauuuuuuuccuauuuuauacucauggaagagauaagcuaaagaggggacaauaaugaga

SEQ ID NO: 704 - RNA, 62 nt, Human
aaucaaaaucacauuggguuauguaaucauuuaacaguauuaauuuuuccaaaacaucaaua

SEQ ID NO: 705 - RNA, 61 nt, Human
aaucaauaacucgcauaugaaguaaaaaggaauacugugaaaggggaguacucuuguacag

SEQ ID NO: 706 - RNA, 62 nt, Human
aaucaauucauguuuaacguuucucauuaaaauccaguauuauauuaucauaucucucuuua

SEQ ID NO: 707 - RNA, 62 nt, Human
aaucacagccucuuugcacagcaugccagcuccucaguguuacauuccucgccagggucucu

SEQ ID NO: 708 - RNA, 51 nt, Human
aaucacagguaguuacugaaaguaacuggaagcaugaacaugcccaccagg

SEQ ID NO: 709 - RNA, 62 nt, Human
aaucaccuccugccuuggcgaggcggcagcucauuguuuacaggcaagcccugcuccuggga

SEQ ID NO: 710 - RNA, 62 nt, Human
aaucacguaguacagaagugcaagaagagaauuuaugaaggaugaauagaacuacaaaccua

SEQ ID NO: 711 - RNA, 61 nt, Human
aaucagaaaucaaucuuucuacuaauguaaauuugagauuauuuuuaaaaauggaauaaaa

SEQ ID NO: 712 - RNA, 61 nt, Human
aaucagcaguauauacaucaccucucacccucaccugcugaaaaaauaaccuuuuuaccca

SEQ ID NO: 713 - RNA, 64 nt, Human
aaucagccuaugugccugacacuggucuugcaguacaacuggaagccaaaacaagguggaagau

SEQ ID NO: 714 - RNA, 62 nt, Human
aaucaggcugagcugaauguagugauguuuacauuguuuacauucuuuguacugucuuccug

SEQ ID NO: 715 - RNA, 62 nt, Human
aaucaguccugggaauagagaguguccuuugugccaguauuacaagaagcccaaacuuuauu

SEQ ID NO: 716 - RNA, 62 nt, Human
aaucauaauuuuauuuguacacacuguuaggggcucaucucauguaggcagaguauaaagua

SEQ ID NO: 717 - RNA, 64 nt, Human
aaucauauuuaccugugaaucaaaacaaauucaagaaugcaguauccgcgagccugcuugcuga

SEQ ID NO: 718 - RNA, 62 nt, Human
aaucauuucuaugaaauguauuuuauuuaaucagauaagcuaauaagcgaauugguuacauc

SEQ ID NO: 719 - RNA, 62 nt, Human
aaucauuuuauuuuauauauuucauguguuuuuuauaagcuauuagcuucgcuuuugcuaac

SEQ ID NO: 720 - RNA, 62 nt, Human
aauccaguaguuuuucuaugcuauuuguuguuguauaagcuacuguaagaaacuuaucauaa

SEQ ID NO: 721 - RNA, 62 nt, Human
aaucccagguccugggccugguuuucuaaugcugucaucucaguucgauauuuuacuuuaga

SEQ ID NO: 722 - RNA, 62 nt, Human
aauccucuucccaggggauugaacagaagcuuaauguuuacaaguguuugaauuugugaucu

SEQ ID NO: 723 - RNA, 64 nt, Human
aaucuaauuuuaggaggaccaaauucaguggauggcaacuggaacauugauuguaaggccagug

SEQ ID NO: 724 - RNA, 61 nt, Human
aaucuaggcacagauaaucuuuaacacuaaacuacugugaaauucuaccagcauuaaguac

SEQ ID NO: 725 - RNA, 63 nt, Human
aaucuauaggaggcgcgauggcaaguugauaaaaugugacuuaucuccuaauaaguuauggug

SEQ ID NO: 726 - RNA, 62 nt, Human
aaucuaugaugcuaauguguuuuccacuguacccucaucucaggaauaaaacugcuuuaacg

SEQ ID NO: 727 - RNA, 62 nt, Human
aaucucucucaaauguauuauuuuggugacaaaaaugaaggagcuuuguaaauuuuuuuuaa

SEQ ID NO: 728 - RNA, 63 nt, Human
aaucugaccagaccccauuuugagaaggucagccuacacuggaaugaacuuuuuacauuaggg

SEQ ID NO: 729 - RNA, 62 nt, Human
aaucugcugcaccuuguaaaugcucuaacuggacaugaaggaaaggggcgagggaggggggu

SEQ ID NO: 730 - RNA, 62 nt, Human
aaucuguagaauucuaaccuucuaacaccugugacaguauuaccacucuucuuguauuauag

SEQ ID NO: 731 - RNA, 62 nt, Human
aaucuguguaauugggcccagauguggguuugcucaguauuaguagacaaggucuuuguuca

SEQ ID NO: 732 - RNA, 64 nt, Human
aaucuguguuggccccugugccucagucccgcggauggccaguagggggcgcuggaggacugcg

SEQ ID NO: 733 - RNA, 62 nt, Human
aaucuucgauaaaauacuguaugaugaacaaaaguguuuacaugaugacaaauggaacuuuc

SEQ ID NO: 734 - RNA, 64 nt, Human
aaugaaauuuaauuuauuuuuaugaauuaaaauuguggccaguauccacuguguccuuaggcug

SEQ ID NO: 735 - RNA, 63 nt, Human
aaugaaguagguuccaguacuaaugaagugggcuccaguauuaaugaaauagguuccagugau

SEQ ID NO: 736 - RNA, 63 nt, Human
aaugacauuaauccauucaagaagauagagcucucgugacuuaaucaccuucuaaagaucuca

SEQ ID NO: 737 - RNA, 64 nt, Human
aaugaccucauaggcacucuuccaaaaagacaacagaacuggaaugagaggccugggucugucu

SEQ ID NO: 738 - RNA, 61 nt, Human
aaugaccuguucaaaccagacucuauuuaaugaacugugaauuuacacagaggccauuuua

SEQ ID NO: 739 - RNA, 62 nt, Human
aaugagagguccagaagaaauguggcuucagcucugcugcuacugugccucccuucuccugc

SEQ ID NO: 740 - RNA, 63 nt, Human
aaugagagugaaagggacaaauaacaucuguguagcaguauuaugaaaauagcuugaccucgu

SEQ ID NO: 741 - RNA, 62 nt, Human
aaugagggcuagagaggcagaggaaggcuagucaauaagcuaaggaggcuccuugccugagu

SEQ ID NO: 742 - RNA, 62 nt, Human
aaugauacccugaauuuggccugcacuaauuugauguuuacagguggacacacaaggugcaa

SEQ ID NO: 743 - RNA, 62 nt, Human
aaugaugagaaacucucuuucugaccaauugcuauguuuacauaacacgcauguacucaugc

SEQ ID NO: 744 - RNA, 62 nt, Human
aaugauucuugggugcugugggucaccaacaggcuguuuacaaagcagaaaauaucaucacc

SEQ ID NO: 745 - RNA, 62 nt, Human
aaugcaggugucugcccaguucacuagguccuggaugaaggaaccgugguggccuagaccag

SEQ ID NO: 746 - RNA, 61 nt, Human
aaugcagguuucuguucucccuccccagcaagaccugcugaacccagaucucuggaauggg

SEQ ID NO: 747 - RNA, 62 nt, Human
aaugccaaacacuccaccucugaucagaaccaugcaguguuaacacuuuaaccuacauugaa

SEQ ID NO: 748 - RNA, 61 nt, Human
aaugccuaugauuagcuucauuaagaguuuuauacugugaagauuuuauuagaagcaauau

SEQ ID NO: 749 - RNA, 62 nt, Human
aaugccuguauuuaugaagacagggccauugcacugcugcuaugcugaaaugaacuuuuaua

SEQ ID NO: 750 - RNA, 62 nt, Human
aaugcggcugggguaugaaaacacugagaaggagaugaaggaguguguguagcaugggggug

SEQ ID NO: 751 - RNA, 62 nt, Human
aaugcuaauaauaguaauugguaacauuaacaaucaguguuagacaacagugaggcauauca

SEQ ID NO: 752 - RNA, 62 nt, Human
aaugcuauuuaaacacaccuaaggugccuuucccucaucucaggugcuuucucuguaaaguu

SEQ ID NO: 753 - RNA, 52 nt, Human
aaugcuggauccuaguuaaggacaacugugaaaaaguucauuccucuuuccc

SEQ ID NO: 754 - RNA, 62 nt, Human
aaugcuuauguuuuuuaugaauuguuaaauauuucaguauuauauagaaaaaaauagauuuu

SEQ ID NO: 755 - RNA, 63 nt, Human
aauggagcaaaacuguauaaacugauuuguaacuaacacuggaccauuggaucgauauuauau

SEQ ID NO: 756 - RNA, 49 nt, Human
aauggagcugacucagugaaaaacuggaauuaaaaggaaagucaagaag

SEQ ID NO: 757 - RNA, 61 nt, Human
aauggcucagggauucagcccucccugccgcugccugcugaagcuggugacuacggggucg

SEQ ID NO: 758 - RNA, 62 nt, Human
aauggggcugcuaagaggggggaaauaugaaggaaugaagggacagcauuggaacggucagu

SEQ ID NO: 759 - RNA, 64 nt, Human
aaugguugaauuaguuugcaaacuauauaaagacauaugcaguaaaaagucuguuaaugcacau

SEQ ID NO: 760 - RNA, 64 nt, Human
aaugguugcuucuucauagaauugucugcuuuuuaaaacuggaaguacaggauuuucuucaggu

SEQ ID NO: 761 - RNA, 61 nt, Human
aauguaagaagacagucccagaaguaaacccucacugugaaucagagaauucacauaggaa

SEQ ID NO: 762 - RNA, 62 nt, Human
aauguaguuuucaugacaauuuuauauugauguguguuuacaaugagaaaauggcaugaaaa

SEQ ID NO: 763 - RNA, 62 nt, Human
aauguauagaagucucccugcaauuaauuuccaauguuuacauuuuuuaacuagacugugga

SEQ ID NO: 764 - RNA, 62 nt, Human
aauguauauacauuuuagacaaaaaugcacacuccaguauuaauauuugugcuaccaucuac

SEQ ID NO: 765 - RNA, 62 nt, Human
aauguaucuuaugaauagagacauauuaaaauaauguuuacaucuuagaaaaaacauagaua

SEQ ID NO: 766 - RNA, 61 nt, Human
aauguauuauucucccaaauuucaaggaauaauugagauuaaguauggaggccauucaagg

SEQ ID NO: 767 - RNA, 62 nt, Human
aaugucagugcagcagcccuaaaugucagugcagcaguguuaaccagucauggugcuagauu

SEQ ID NO: 768 - RNA, 61 nt, Human
aaugucuuuugcacaaacuuuguaacuuuuguuacugugaauucaaacauuacucuuugga

SEQ ID NO: 769 - RNA, 62 nt, Human
aaugugagcucuccugguaaauaguauacauuuuauaagcuauauuuuaaaggccuaagaac

SEQ ID NO: 770 - RNA, 61 nt, Human
aaugugaugucuuuguauauaucuguauaauguugagauuacuuacgaaauaugucugagu

SEQ ID NO: 771 - RNA, 62 nt, Human
aaugugauuuuuauucugcuuguauuuaaaauugaugaaggaaaggagcuggguggcugcgc

SEQ ID NO: 772 - RNA, 62 nt, Human
aauguggccuugaauuuuaacucuguaugcuuaauguuuacaauaugaaguuauuaguucuu

SEQ ID NO: 773 - RNA, 61 nt, Human
aaugugucugauuugguaugcauuauuucaaaaacugugaauguguguuaauaacacuaca

SEQ ID NO: 774 - RNA, 62 nt, Human
aaugugugccuguaccauaauguauucauccagaaugaaggaaguuugggcuguuucuauuu

SEQ ID NO: 775 - RNA, 62 nt, Human
aauguucauuaacagcaucuuuaaaacuguguagcuaccucacaaccaguccugucuguuua

SEQ ID NO: 776 - RNA, 64 nt, Human
aauguuccaaagagccagaagcauucagcucuccuuaacuggaagagagaaaaaucugcucacc

SEQ ID NO: 777 - RNA, 63 nt, Human
aauguuucauaaaaauaaagcuuaaaaauugucuuacacuggauaaaagugauauuaagcuug

SEQ ID NO: 778 - RNA, 62 nt, Human
aauguuuuuaauuugcugacuuacagacacaggcuguuuacaaaaugcuagcuggaaagucu

SEQ ID NO: 779 - RNA, 62 nt, Human
aauuaaaaauauuuaaauccacaauuugauauaacaguauuauuuacauaagaacaaaguuu

SEQ ID NO: 780 - RNA, 64 nt, Human
aauuaaaacuggacauuaagcucuguugucaugaacaacuggaauguaaaccacaguauuuugg

SEQ ID NO: 781 - RNA, 64 nt, Human
aauuaaaggcaccuucuuuacagcagggcucuggggaacuggaaaaggggguuuguuucauuau

SEQ ID NO: 782 - RNA, 62 nt, Human
aauuaacaagaaaacauuucuuccugauugacaacaguguuagacaaggugcaaagcgaaac

SEQ ID NO: 783 - RNA, 64 nt, Human
aauuaauaauguuuauaagcugggcauggucgcucaggccaguaaucccagugacuuaggaggc

SEQ ID NO: 784 - RNA, 64 nt, Human
aauuacaacuuggugcagauacaguauauucucaucaacuggaagguuauuuugcaaaauuccu

SEQ ID NO: 785 - RNA, 62 nt, Human
aauuagauaugcaucuggcauuguuuuaucuuaucaguauuaucacucuuauguugguuuau

SEQ ID NO: 786 - RNA, 62 nt, Human
aauuaggaauuggaugcaucauuccuguguguuacaguauuauuuuaauuggccucaauggu

SEQ ID NO: 787 - RNA, 61 nt, Human
aauuaguagauuuuuuaccauguuaaauuauagugagauuaaaguauuacuaaacugugau

SEQ ID NO: 788 - RNA, 63 nt, Human
aauuauaucuuuaauauauaguaauguaacauauucaguauuaauguauaaaaagcacucuaa

SEQ ID NO: 789 - RNA, 62 nt, Human
aauuaugauuaaucaccaucugccuccaggccuuucaucucaugacaaacaaauauaauaau

SEQ ID NO: 790 - RNA, 62 nt, Human
aauuauuuuuaaagauuuacacagauuugaauagcaguguuaacuguuaaccacauugcauu

SEQ ID NO: 791 - RNA, 62 nt, Human
aauucaaauacauggaggcacaucuucagggcaccaguguuaaaauuuuggagucuuaauuu

SEQ ID NO: 792 - RNA, 62 nt, Human
aauucaaccaaaaucucauggguuaguuaaccaggugcaauacagcacaccaaaagcuugac

SEQ ID NO: 793 - RNA, 64 nt, Human
aauucacaaaaaguaaaccaaacaaaacgaaugaaaaacuggaaauaauucguuuccauaucuu

SEQ ID NO: 794 - RNA, 61 nt, Human
aauucacuuaaguuuuuccaaaaccucaguuaaacugugaagcuauuggaauuuuuuuuuc

SEQ ID NO: 795 - RNA, 62 nt, Human
aauucaguauuuuaacaaaaggaaugaaaaauuaucaucucaauagacaaagcuuuugucug

SEQ ID NO: 796 - RNA, 63 nt, Human
aauucauuguuuuuaaauuuagacuucuuauuuccacacuggauuaugagauacuuaacaauu

SEQ ID NO: 797 - RNA, 62 nt, Human
aauuccauacagugaaggaaauuugagucuguauugcugcuacaaggguaaaaccaggacca

SEQ ID NO: 798 - RNA, 63 nt, Human
aauucccaaagcaucacugaacuugcccagccgggacacuggagacugaagaaguuccccgga

SEQ ID NO: 799 - RNA, 62 nt, Human
aauucccucaucuauaaaauggggauaauauuaucuaccucacaagcuuaugaaaacuaaac

SEQ ID NO: 800 - RNA, 61 nt, Human
aauuccuuggaauuuaucguauauuguauucacugagauuaugaagggacaaauguuaauc

SEQ ID NO: 801 - RNA, 64 nt, Human
aauucuaaggagcuugaucaggagggcuggaauauaaacuggaauaugggagaauuaaucaauu

SEQ ID NO: 802 - RNA, 62 nt, Human
aauucugcguuuuugguuuuaauguuauaucugaugcugcuauauccacuguccaacggcac

SEQ ID NO: 803 - RNA, 62 nt, Human
aauucuuuauaaaaugugggucauagauaugacccaguguuacuaaaauagaacagggauug

SEQ ID NO: 804 - RNA, 61 nt, Human
aauucuuuuuauuaugacuaugcccuucgcaacacugugaaaacaaccccugggggcaucu

SEQ ID NO: 805 - RNA, 62 nt, Human
aauugaauacuuugaauguguuucacaguuugaaauaagcuauuugauguaauacuucuugu

SEQ ID NO: 806 - RNA, 62 nt, Human
aauugacauuauuuucucauuugcuuuguaugguaugaaggauuuguaaagcuuugcucaaa

SEQ ID NO: 807 - RNA, 64 nt, Human
aauugagucaguaaaccugugauagauaauuuauuuaacuggaaaaccuagguacccauaagaa

SEQ ID NO: 808 - RNA, 62 nt, Human
aauugcugagguuuccuuaggcagcuuauuuauuuguuuacaguuagacuaucugaguaaau

SEQ ID NO: 809 - RNA, 62 nt, Human
aauuguacugcuaacugaacuaugcauaucuaacucaucucaaaugacucauaaugaggcgc

SEQ ID NO: 810 - RNA, 62 nt, Human
aauugugagguuaauguuuaaaaagcuuuacaccuguuuacaauuuggggacaaaaaggcag

SEQ ID NO: 811 - RNA, 62 nt, Human
aauuuaaaaacuugugauuuaagaagaggaaaagauaagcuacagauugagaugaauuugca

SEQ ID NO: 812 - RNA, 62 nt, Human
aauuuauaauuagggauuguucaaacuucagaucuguuuacagguuguaaaaauaaacuucg

SEQ ID NO: 813 - RNA, 62 nt, Human
aauuuauguacucuauaacggugugaaugauuaccaguauuaagccauuuucucaucugaua

SEQ ID NO: 814 - RNA, 61 nt, Human
aauuuauuucuuaagaaaaagcaucccucauuuacugugaacuaaaguucauucuguagug

SEQ ID NO: 815 - RNA, 62 nt, Human
aauuuauuuguaaaauccauaaaguacuucuguacaguauuagauucacaauugccauauau

SEQ ID NO: 816 - RNA, 63 nt, Human
aauuucacuuucugaucacgguacguccauaaagccaguauuacacuuaaaugaaguauucuu

SEQ ID NO: 817 - RNA, 62 nt, Human
aauuucauuguuuaacuggcuggugugagaagucuuccguuagcauagaguggaaggaguac

SEQ ID NO: 818 - RNA, 62 nt, Human
aauuucauuuuaaucauuggacaccuuugcguuuugcugcuaacaguguguguaugucaccc

SEQ ID NO: 819 - RNA, 62 nt, Human
aauuuccaugggucaauaacauaaggugucaguucaguguuacuagagauaugcaaggcaua

SEQ ID NO: 820 - RNA, 63 nt, Human
aauuuccuauuuuggauuuaguuuugucaaugguagugacuuacugaacaugggcaccaacua

SEQ ID NO: 821 - RNA, 62 nt, Human
aauuuccucaaccauaaaaugaagauaauaaugccuaccucagagggaugcugaccacagac

SEQ ID NO: 822 - RNA, 61 nt, Human
aauuuccugccucagaaaaagcuuuuccauuacacugugaaugauaccuguuuuguuguuu

SEQ ID NO: 823 - RNA, 61 nt, Human
aauuucuagcaaccuuagauggagagguggcucugagauuagcauccccacaggcccaccu

SEQ ID NO: 824 - RNA, 64 nt, Human
aauuugauaaugacuuuagugacauuauaaaacugaaacuggaaaauaaaauggcuuaucugcu

SEQ ID NO: 825 - RNA, 62 nt, Human
aauuuguauuacuagucauaugcauguagcuuucuguuuacauccuaugccacauggucuuc

SEQ ID NO: 826 - RNA, 61 nt, Human
aauuuguguuaugcuaacaucuucagggucugcacugugaacuccccuggagauaaguaag

SEQ ID NO: 827 - RNA, 62 nt, Human
aauuuguuuaaugcuucccuucccuucccacauaucaucucacugccuauuaucugguguca

SEQ ID NO: 828 - RNA, 62 nt, Human
aauuuuaaggauugacaagaguuuauuuucuauugugcaauaucuuaaaggaagcaaccacc

SEQ ID NO: 829 - RNA, 63 nt, Human
aauuuucaagcaacucaaagauuaucuauacacaaaacgguuauuuauauagaagucacaagu

SEQ ID NO: 830 - RNA, 62 nt, Human
aauuuucacaucuuuaaaaugggaauaauaguaccuaccucauaggguuguuguaaggaaua

SEQ ID NO: 831 - RNA, 63 nt, Human
aauuuuccagugaugaaauugugaaucaggcagucacacuggacaacaucuagcaaggugaau

SEQ ID NO: 832 - RNA, 62 nt, Human
aauuuucccuuccuccgccuuccucucccucuccuguuuacacuccccaaaugcgcacaggc

SEQ ID NO: 833 - RNA, 62 nt, Human
aauuuugaugccaagaaaguauuugguaggccuaaugaaggaguucacuguaagacucauuc

SEQ ID NO: 834 - RNA, 62 nt, Human
aauuuugccgauuucaugacuaaccaguccaaggaugaaggaaaaacuggaccucauuaugg

SEQ ID NO: 835 - RNA, 62 nt, Human
aauuuuguacuauaauucuaacuucuauuuugaaauaagcuaguuugguuggaaaaauuuug

SEQ ID NO: 836 - RNA, 64 nt, Human
aauuuuguuucaaauugugauuucauugauuuuacuaacuggaaggaagaagaguaaaauuggc

SEQ ID NO: 837 - RNA, 62 nt, Human
aauuuuucuugcuuugaacccugucauaaugacugugcaauacaugugcagaagaugaggua

SEQ ID NO: 838 - RNA, 62 nt, Human
aauuuuugcugaugaaagugcuucauugacuaaacaguauuaguuuguggcuauaaaugauu

SEQ ID NO: 839 - RNA, 62 nt, Human
aauuuuuguaagaaaccgaggcgaugccacgcuuugcugcuaccgcccugggcuggacugga

SEQ ID NO: 840 - RNA, 63 nt, Human
acaaaaaaaagaugaaaacauauuuauacuacaaggugacuuaacaacuauaaauguaguuua

SEQ ID NO: 841 - RNA, 62 nt, Human
acaaaaaaaucauauauaauagagcucuuuguuccaguguuaucucuuucauuguuacuuug

SEQ ID NO: 842 - RNA, 61 nt, Human
acaaaaacaaaaccagccaaccuauguuacacgugagauuaaaaccaauuuuuuccccauu

SEQ ID NO: 843 - RNA, 61 nt, Human
acaaaaaugccuuaauuugagcucguauuuaccccugcugauaagugacuugagaguuccc

SEQ ID NO: 844 - RNA, 62 nt, Human
acaaaacaaaucuuauguugcauuuacuaucaacugcugcuaauacguuauuauaaaacuua

SEQ ID NO: 845 - RNA, 61 nt, Human
acaaaagagcagauuccuaaagccaggugcagcacugugaaaaguuucuuucaauauggca

SEQ ID NO: 846 - RNA, 62 nt, Human
acaaaagggcacuuuuuacaccaaggaagcagagcaguguuaacuuuaagguauacuuaacu

SEQ ID NO: 847 - RNA, 62 nt, Human
acaaaauaacaaaaacaacccuuccucuuuucucucaucucaccucucuguguugauuacua

SEQ ID NO: 848 - RNA, 64 nt, Human
acaaacaaacaaacaaacaacguaucuuacugacuaaacuggaauggaaaucuuauaauuagug

SEQ ID NO: 849 - RNA, 61 nt, Human
acaaacaugguggcaauucuacacaaaaagagaugagauuaacagugcaggguuggggucu

SEQ ID NO: 850 - RNA, 59 nt, Human
acaaaccaccauugccugaccuggcucuuaucaguguuaauagcaucucagcuuccuca

SEQ ID NO: 851 - RNA, 64 nt, Human
acaaacugaaaauuauugcaagcauugacuauaauuaugcaguacguucucaggaugcauccag

SEQ ID NO: 852 - RNA, 62 nt, Human
acaaagaaucgcaaauucuucaaaugacuauuaucaguauuauuaacaugcgaugccacagg

SEQ ID NO: 853 - RNA, 62 nt, Human
acaaaggaucuuucaugaauguccaaggguaagucaguauuaauuaaugcuguauuacaagg

SEQ ID NO: 854 - RNA, 62 nt, Human
acaaauuagcaaucauuuuauauaaagaaaaucaaugaaggauuucuuauuuucuuggaauu

SEQ ID NO: 855 - RNA, 64 nt, Human
acaacauuuuucauuauaacuuuaaauuuuuuaagcaacuggaaaaguguuccuugcucucuug

SEQ ID NO: 856 - RNA, 61 nt, Human
aggugauccgccugccucagccuuccaaagugcugagauuacaggcaugagccgcuguacc

SEQ ID NO: 857 - RNA, 61 nt, Human
aggugaucugaccgccuuggccuccgaaagugcugagauuacaguugcgagccacugugcg

SEQ ID NO: 858 - RNA, 61 nt, Human
aggugaucugucugccucggccucccaaagagcugagauuacaggcgugagccaccaugcc

SEQ ID NO: 859 - RNA, 64 nt, Human
aggugcugugggcuggucccacacauccaggaaagaggccaguagagaauucugcccacuuuuu

SEQ ID NO: 860 - RNA, 61 nt, Human
aggugcuuagggcugcaucuugguuuuaggaccacugugaacguaaguaaaaaguauaaag

SEQ ID NO: 861 - RNA, 62 nt, Human
agguggaauggcuagacacugaaucaagagauuucaguguuacucuggucaaguuagucgcc

SEQ ID NO: 862 - RNA, 62 nt, Human
agguggcccccguccgaggaggaucguuuucuaagugcaauacuuggcccgccggcuucccg

SEQ ID NO: 863 - RNA, 62 nt, Human
agguguuaacaucuguuucaggaacauggcaguauguuuacaugucagaaguuuuguuuaau

SEQ ID NO: 864 - RNA, 62 nt, Human
agguguuauagugucgccacucgucuaauuugaccaguguuaagaauuuucuaauuuaauaa

SEQ ID NO: 865 - RNA, 62 nt, Human
agguucauguucuaugauguaaaaucaagacacacaguguuaacucuacacagcuucuggug

SEQ ID NO: 866 - RNA, 61 nt, Human
agguucucuaaguucuggggagggagcgccccaccugcugaggucgguccucucagcccug

SEQ ID NO: 867 - RNA, 62 nt, Human
agguucuuuagcugucacuuagggauaacacugucuaccucacagaaauguuaaacugagac

SEQ ID NO: 868 - RNA, 62 nt, Human
agguuggcauucaauaaggaaaaaguucuaacuccaguauuaaauuguacauaaaucccaaa

SEQ ID NO: 869 - RNA, 62 nt, Human
agguugguuacuauaauaccccucaguaagauuccaguauuaauuucugggcaguuuguucu

SEQ ID NO: 870 - RNA, 63 nt, Human
agguuuggacagaguggucaucaaaggccagcccugugacuuacacugcauuaaauuaauuuc

SEQ ID NO: 871 - RNA, 62 nt, Human
agguuuuaggauuuucaugguaacaagcucugguauaagcuaaggcuggcaaguucagauac

SEQ ID NO: 872 - RNA, 62 nt, Human
aguaaacccaucuuuccuuaacgaaaauuuccuauguuuacagucugucuauugguaugcaa

SEQ ID NO: 873 - RNA, 62 nt, Human
aguaaaguaaacauuaucgcuaaguguacuugugcaguauuaacagcuacauuauacaguaa

SEQ ID NO: 874 - RNA, 61 nt, Human
aguaacagggauuacaggcauacuccaccuugcccugcugauuuuguauuuuuaguagaga

SEQ ID NO: 875 - RNA, 61 nt, Human
aguaacaguaugucagauaagccgguggggggaugagauuaggcugaggcagugcuaguca

SEQ ID NO: 876 - RNA, 61 nt, Human
aguaaccaggcaaagucaaccagaugccuagcuccugcugagacccagguccuauggcagc

SEQ ID NO: 877 - RNA, 62 nt, Human
aguaacccucagcacuacuauucucucuuaaaagauaagcuauuuaaccccaaacauuugga

SEQ ID NO: 878 - RNA, 63 nt, Human
aguaagacaacauagcccagauccucacagguguugugacuuauucguccugagcacaguuga

SEQ ID NO: 879 - RNA, 62 nt, Human
aguacccaauggcaucucuccaucuacaaaguugcaguauuaugcaaauaaaacugaccuca

SEQ ID NO: 880 - RNA, 60 nt, Human
aguaccccagucgaccuaaaagucagugauucaacuggaaggaaaccucaaugcugccuc

SEQ ID NO: 881 - RNA, 62 nt, Human
aguaccuccauaauuguucuaaucuucuucccacuguuuacaaauuaccaguuaauuaacuc

SEQ ID NO: 882 - RNA, 63 nt, Human
aguacuuagucacguggcuacaucuagcuguagagacacuggaaaauaugucuuuauuccaag

SEQ ID NO: 883 - RNA, 63 nt, Human
aguacuuaguugaaacaaaaaggaauuuuaguagacaguauuauauuaucuuugaaaaucaag

SEQ ID NO: 884 - RNA, 63 nt, Human
aguacuuaguugaaacaaaaaggaguuuuaguagacaguauuauacuacauuugaaaaucaag

SEQ ID NO: 885 - RNA, 62 nt, Human
aguacuuugcugagugaaaucaccauauagaauucaguauuaacagaucaugcauucagaug

SEQ ID NO: 886 - RNA, 62 nt, Human
aguagaauaugcccugagaaugaaaagaauguaacaguguuaguauuuugaauaaacauguu

SEQ ID NO: 887 - RNA, 62 nt, Human
aguagaggggcagguagaguuccuggagggaaggaugaaggagccuuggcuacuguacucug

SEQ ID NO: 888 - RNA, 62 nt, Human
aguagccaugcuuugguuguguguuuggccuuuucaguauuagacaaucauucuacaagagc

SEQ ID NO: 889 - RNA, 62 nt, Human
aguaggagaaaacugcaaccaaggaagaauagagucaucucacggugacagcagagccuuuc

SEQ ID NO: 890 - RNA, 63 nt, Human
aguaguaagaauacuggcaucccugcacccucaccacacuggauggaugguauuggcuuucug

SEQ ID NO: 891 - RNA, 64 nt, Human
aguaguucuguaagaaaaaaguauuaugugcauuuuaacuggaaaaauauguauaaaaauguua

SEQ ID NO: 892 - RNA, 61 nt, Human
aguaguuugcccauggcaaaccuaaauuuaugaccugcugaggccucucagaaaacugagc

SEQ ID NO: 893 - RNA, 62 nt, Human
aguauaaagagucuguauuuuuaauaaauguuaaauaagcuaacaauguuuguacuuaugca

SEQ ID NO: 894 - RNA, 63 nt, Human
aguauagugcagauucuauguaaaacuacuaaaugacacuggaauauguuuaguagauuaggg

SEQ ID NO: 895 - RNA, 63 nt, Human
aguaucgucuccagccagcccugcuuauccagguuacacuggauuccugggaucguaaccagu

SEQ ID NO: 896 - RNA, 62 nt, Human
aguauguaaauuugcucuguuuuaagacuuugaacuaccucaagaagaggaaucuaauacaa

SEQ ID NO: 897 - RNA, 63 nt, Human
aguauguacagucuacuuuugaacuauuuuuaucacaguauuauuuauugcuuucuuucaaua

SEQ ID NO: 898 - RNA, 61 nt, Human
aguauuacaucuuuuauauucuggaagaaaagaacugugaacaaauuagaaccccggaaca

SEQ ID NO: 899 - RNA, 62 nt, Human
aguauuauccacuggucagauggucaacuuuuuucaguauuauuuauaguuggcacuugauu

SEQ ID NO: 900 - RNA, 64 nt, Human
aguauuggaaugauguuuucauuuuugguggcucucaacuggaauugguaguguuuccaggcca

SEQ ID NO: 901 - RNA, 61 nt, Human
aguauugugaauguagauuuuacugugaagcuaucugugauuuagcuguuugcucccauga

SEQ ID NO: 902 - RNA, 63 nt, Human
agucaaaccucuaugcuccuucaaaaucagaguucacacuggaucaaggcuuuauggugugac

SEQ ID NO: 903 - RNA, 62 nt, Human
agucaacuaagcuacuuuuagauuuggaaauugcuguuuacagucuaacaacauuaaaauga

SEQ ID NO: 904 - RNA, 61 nt, Human
agucaaggagcuucucccucuagacuccagccuccugcugagucaccugcaccgucucugc

SEQ ID NO: 905 - RNA, 61 nt, Human
agucaaguuuaauuucaaaaaaccuuuuuuuucugagauuacuuuugggguaauauuuaaa

SEQ ID NO: 906 - RNA, 62 nt, Human
agucacaauuggguagaugugacauccauauacuuguuuacauuuuaucuguucucauguca

SEQ ID NO: 907 - RNA, 63 nt, Human
agucaccagccuuaaugcauguacaggauauuauugugacuuaauuuaucugcaguuuuuaau

SEQ ID NO: 908 - RNA, 62 nt, Human
agucaccuggaaagaacagagauuacccuuucaccuaccucagcaaaacaaacuuucaaguc

SEQ ID NO: 909 - RNA, 57 nt, Human
agucagcacuguacacuagaaggguuccaugagauuauuguagacucaugaugcugc

SEQ ID NO: 910 - RNA, 63 nt, Human
agucauaaaauagggagaaaguuuucuucuugcucacacuggauuccuaggacuuaucagaga

SEQ ID NO: 911 - RNA, 62 nt, Human
agucauccuggugcuuguacuucuccuacaugucaugaaggaccuuggauuuacugagaacu

SEQ ID NO: 912 - RNA, 62 nt, Human
agucauguuuacugcauauugcaguccacuaaaugugcaauagcauuaugucuaacaaaugu

SEQ ID NO: 913 - RNA, 62 nt, Human
agucauugguuauacauguguaguuccaaagcacauaagcuagaagaagaaauauuucuagg

SEQ ID NO: 914 - RNA, 64 nt, Human
agucauuuaaaauuuuuucuucucuggcaacuguccaacuggaauccagauuuaaagugauaaa

SEQ ID NO: 915 - RNA, 62 nt, Human
aguccaaaaaaguguuuauuuuuuauggaauacggugcaauaggcagaggacaagggacaca

SEQ ID NO: 916 - RNA, 62 nt, Human
aguccaggagcucaggaagaagagaugcacuauauguuuacacaauuaauucaucccuuaau

SEQ ID NO: 917 - RNA, 62 nt, Human
aguccaggcaacugacaugcuuuuauuagucauacaguauuaaugcaggugucaggaaaugu

SEQ ID NO: 918 - RNA, 64 nt, Human
agucccagggccccuccugaggaugcucgccagggaaacuggaaacaggggcagggcaaagacu

SEQ ID NO: 919 - RNA, 62 nt, Human
aguccuguuccagaaguaccaggcuguagauuugauaagcuagaugcaguagaccgaaacca

SEQ ID NO: 920 - RNA, 63 nt, Human
agucucuaaauuugauggaaauggacacuugaguagugacuuagccuuauguacucuguugga

SEQ ID NO: 921 - RNA, 63 nt, Human
agucugaauugcccacugcuggauguguaaaauguacacuggaauuuaaagacagcgcagaaa

SEQ ID NO: 922 - RNA, 61 nt, Human
agucuguuuagaagaaaaagcaaagacugagguacugugaauggagagcuucagcuaagag

SEQ ID NO: 923 - RNA, 62 nt, Human
agucuucuuuuuuacaauaauguaaaaauuaaacuguuuacauuuuuuuaaagcauuguagu

SEQ ID NO: 924 - RNA, 62 nt, Human
agucuuggggaugauagcugguucaacaguauuuugcugcuaauacuuuauguugcuucuug

SEQ ID NO: 925 - RNA, 62 nt, Human
agucuuuuucuuuaauaugccuuuaagucuuaccuguuuacagcccauucugauggguucuu

SEQ ID NO: 926 - RNA, 62 nt, Human
agugaaaacauuuagggacacccaaagaaugaugcaguauuaaaggggugguagaagcugcu

SEQ ID NO: 927 - RNA, 62 nt, Human
agugaaaugcaaaaauauucccguuaucuuugaccaguauuaauuuuugagaucuuacugcu

SEQ ID NO: 928 - RNA, 62 nt, Human
agugaacaucaguuuuaucaaagcaguaaauuuagugcaauaaauuugcaaacuuauuaacg

SEQ ID NO: 929 - RNA, 62 nt, Human
agugaacucuugguccucaguagugagaugauaacaguguuauaaugcagcuuccuugagcc

SEQ ID NO: 930 - RNA, 61 nt, Human
agugaaggaagagaacagagacaaacucuuuggacugugaaagagaagguagagaauucca

SEQ ID NO: 931 - RNA, 62 nt, Human
agugaauuauuuugauguaggcuuuuguauacuguguuuacacagguauaagucaguaauag

SEQ ID NO: 932 - RNA, 62 nt, Human
agugacaacugaacacacuguguuggaucggagguuccguuaggggauccuuccuuaggcuu

SEQ ID NO: 933 - RNA, 62 nt, Human
agugacaaggacgcccgaagcacaguggacggucaugaaggagcggggguguggcaggcggg

SEQ ID NO: 934 - RNA, 61 nt, Human
agugaccccagagacuuugcuguaauuaucugcccugcugacccuaaagaccuuccuagaa

SEQ ID NO: 935 - RNA, 62 nt, Human
agugacccugccugccuauggaauggagcuggguucaucucaucacauuagauuaucccuca

SEQ ID NO: 936 - RNA, 62 nt, Human
agugacucuuuacuguaggaaaaauauuacucuguguuuacagauucauugcuguggucagg

SEQ ID NO: 937 - RNA, 61 nt, Human
agugauauaucuuuuuuccuaaauugcuuaaauacugugaaauugcucugacaaauuggaa

SEQ ID NO: 938 - RNA, 62 nt, Human
agugauggggcacucaagaaaguucagaggaggcauaagcuauggagguuggaaaggaagaa

SEQ ID NO: 939 - RNA, 62 nt, Human
agugaugugugagauucccagagagucgucacaccaguguuaugccugggagugccacuggc

SEQ ID NO: 940 - RNA, 61 nt, Human
agugauucucccugccucaaccuccugaguagcugagauuacaggcacccaccaccaugcu

SEQ ID NO: 941 - RNA, 64 nt, Human
agugauucucucuguuaguagcugggucacauuuacaacuggaaaagaacuacauugggagauc

SEQ ID NO: 942 - RNA, 62 nt, Human
agugcaaagccagcaugcgaguucagcuuccauuugcugcuauaaauuuuguucuuguugcu

SEQ ID NO: 943 - RNA, 62 nt, Human
agugcaaagcuauguauuuaucaugguaaaacuccaguguuagaauaguuuuuucuuacagu

SEQ ID NO: 944 - RNA, 62 nt, Human
agugcaaucuugccagauuucuagcaaauagguucaguguuaccauaagccuuugcuguacu

SEQ ID NO: 945 - RNA, 62 nt, Human
agugcagcuguaggucgucaucaccuaaccacacgugcaauaaaguccucgugccugcugcu

SEQ ID NO: 946 - RNA, 63 nt, Human
agugccaacaaagacaacacuaaucagcacaucguacacuggauugcagugcuucccagauua

SEQ ID NO: 947 - RNA, 64 nt, Human
agugccucaccacacggcccggaaacagcgggaaguaacuggaaagagcuuuaggacagcuuag

SEQ ID NO: 948 - RNA, 63 nt, Human
agugcuuaguugaaacaaaaaggaguuuuaguagacaguauuauacuaucuuugaaaaucaag

SEQ ID NO: 949 - RNA, 61 nt, Human
aguggaaagguggucuggagccccuucccucucccugcugaccugggagucgcaggcaccc

SEQ ID NO: 950 - RNA, 63 nt, Human
aguggaguuaucaagugagguccagguagccugcaacacuggaaaugaguucuggguaaguga

SEQ ID NO: 951 - RNA, 62 nt, Human
aguggcaucagucucacucaucuuggugccccgguguuuacaagagccagauggugucagag

SEQ ID NO: 952 - RNA, 63 nt, Human
aguggccugaaacaguguagggaaagaccugggaaacacuggaccaaaaaagccugaucucau

SEQ ID NO: 953 - RNA, 62 nt, Human
aguggguggagaguggagugcgcugggacguugugugcaauagagaggucuccacaccagau

SEQ ID NO: 954 - RNA, 61 nt, Human
aguguaaagaaugucucagucugccuuaaaggaacugugaaggcuucucuguaauuuaagc

SEQ ID NO: 955 - RNA, 62 nt, Human
aguguacaaugccuuugaugaacuguuuuguaagugcugcuauaucuauccauuuuuuaaua

SEQ ID NO: 956 - RNA, 64 nt, Human
aguguauguuugcaugcugucuucaacuuagaggagaacuggaagucaggagccuuugaugucc

SEQ ID NO: 957 - RNA, 62 nt, Human
aguguguaaggccguauuuuuagcaucugacagguguuuacaaaaaagugguugucgcacug

SEQ ID NO: 958 - RNA, 62 nt, Human
agugugucagauggucuuuauauauuuuuucuguaugaaggaauagccuugccuacugaaga

SEQ ID NO: 959 - RNA, 62 nt, Human
aguguucuauauuuauuucuguuugaauuugaaacaguguuaugcuuacaagacuucauaau

SEQ ID NO: 960 - RNA, 62 nt, Human
aguguugguguucugaaaucugcuuguaaaacucucaucucauuuuacauugauauuaaaac

SEQ ID NO: 961 - RNA, 62 nt, Human
aguguugucaauuugauuauugacacauauaacauguuuacaaauaaacugugguauugauc

SEQ ID NO: 962 - RNA, 62 nt, Human
aguguuuaaaacuuuugacaagugguaguccuacuguuuacacucacaguuaauguucauac

SEQ ID NO: 963 - RNA, 64 nt, Human
aguguuuauuuauauguucgguaaaugcucucgcauaugcaguaccucuucugccagcaaaucc

SEQ ID NO: 964 - RNA, 61 nt, Human
aguuaaaaacugccaguguauuguggcaaacaaacugugaaacuuaaagauugauuuuauc

SEQ ID NO: 965 - RNA, 62 nt, Human
aguuaacuaugaacagauagaagaaucuuacagaugcugcuauaaauaaguagaaaauauaa

SEQ ID NO: 966 - RNA, 62 nt, Human
aguuaaggugugaggcacucccggagcaaagucuaugaaggaucuucugcaagaggcugccu

SEQ ID NO: 967 - RNA, 63 nt, Human
aguuacagagugaacacucuacuacaugugacuggcaguauuaagugugcuuauuuuaaaugu

SEQ ID NO: 968 - RNA, 63 nt, Human
aguuauauuuucuuucuuuucugaucagguuauuggugacuuacuggacuggcaccgccagga

SEQ ID NO: 969 - RNA, 62 nt, Human
aguuauuuauaacagagaccucuagugcugcacuuguuuacacaccuuugaaaaucuggaaa

SEQ ID NO: 970 - RNA, 64 nt, Human
aguuauuucagggcacagauaccuuguagguaaaacaacuggaaaccuuggaaauaggugggaa

SEQ ID NO: 971 - RNA, 64 nt, Human
aguucagugcuacucugcgugauucaagcuuuccugaacuggaacgucgggggcaaagcauaca

SEQ ID NO: 972 - RNA, 61 nt, Human
aguucauguuggaaacuuuugucacggcuuuauugagauuaaguucacauacaauuuguau

SEQ ID NO: 973 - RNA, 62 nt, Human
aguucccacacguagaagggaacgaaacugacgucuaccucauggggcugcuguguggguuu

SEQ ID NO: 974 - RNA, 64 nt, Human
aguucccgccagccuccaacacggggacucugccguaacuggaaucuucauaggucauauugaa

SEQ ID NO: 975 - RNA, 62 nt, Human
aguucccucguauguaaaaugaugauaauaauaccuaccucacaggguuguugugaggauuu

SEQ ID NO: 976 - RNA, 62 nt, Human
aguuccuggauguuccucuguagauaacaucaagucaucucaaaccucacaaaaccagggac

SEQ ID NO: 977 - RNA, 62 nt, Human
aguucuaagcgggagaugacucccuacugggaugaugaaggauggcauccuagugaagaagc

SEQ ID NO: 978 - RNA, 61 nt, Human
aguucuaccggcuuugccaugugcuucugccacccugcugagucuguucugguaaucgggg

SEQ ID NO: 979 - RNA, 62 nt, Human
aguucucacugugaacuggagauggcaauaggaccuaccucagagucguaaaaugcaggauu

SEQ ID NO: 980 - RNA, 62 nt, Human
aguucugcucuagacaguguagggcaacaauacaugcugcuaauucaaagcucuauuaagau

SEQ ID NO: 981 - RNA, 61 nt, Human
aguucuggaauggaaggguucuggcugccccaaccugcugaagggcagagguggagggugg

SEQ ID NO: 982 - RNA, 62 nt, Human
aguucuguugaaaucucacgcuguugucaggaaucaguguuauccuggaacuguuauucuau

SEQ ID NO: 983 - RNA, 61 nt, Human
aguucuuaguugcuggcucugcucggcaccgggacugugaaggguguacucccugcugugu

SEQ ID NO: 984 - RNA, 63 nt, Human
aguucuucuaaagccuacguugguuaggcugauggcaguauuauaguugcuaaauucagcacu

SEQ ID NO: 985 - RNA, 64 nt, Human
aguucuugccuuggcugcaguuuuuuuccuucaagaaugcaguacuaacauuuauuugagugga

SEQ ID NO: 986 - RNA, 62 nt, Human
aguucuuucaugguaagcucaauggacuuugaauuguuuacagugcuguauguccaauuguu

SEQ ID NO: 987 - RNA, 62 nt, Human
aguucuuuccaguuuguuuuuggcuccccaagcaucaucucacgaggagaacuuuacaccua

SEQ ID NO: 988 - RNA, 62 nt, Human
aguuggagagcagacugggcaacauagcgagaccucaucucaaacuggggugaggcggaucc

SEQ ID NO: 989 - RNA, 61 nt, Human
aguuggcucuggaccugcauuaaaauggguuucacugugaaugcgugacaauaagauauuc

SEQ ID NO: 990 - RNA, 62 nt, Human
aguuggcugcacuugauguuuguuugcaugaugucuaccucagaauuaaaacuuuaaggaag

SEQ ID NO: 991 - RNA, 61 nt, Human
aguuggggugggggugguucugcauucccuucuccugcugauagcagucagcuugaggagg

SEQ ID NO: 992 - RNA, 62 nt, Human
aguuguaauauuuuuacaggauauuccuagguaaaugaaggagccuucaguuguaaauuuca

SEQ ID NO: 993 - RNA, 62 nt, Human
aguugugugaagaugucaaaaaaagauuuuagaagugcaauauuuauaguguuauuuguuuc

SEQ ID NO: 994 - RNA, 62 nt, Human
aguuguucaggcugccaauugcaagcucauuccucuaccucauacuuccucugaggauuuug

SEQ ID NO: 995 - RNA, 62 nt, Human
aguuguugaauuuccuuauacauuuaaaguguacuuccguuaagaauuauuccauuuuaaau

SEQ ID NO: 996 - RNA, 62 nt, Human
aguuuacuaugcgcaaauacugugaaaugcccgccaguguuacagcuuucuguugcagcaga

SEQ ID NO: 997 - RNA, 62 nt, Human
aguuuacucaucugcgaaguggggauaauaaaaccuaccucaggguugcuucaaggauuaaa

SEQ ID NO: 998 - RNA, 62 nt, Human
aguuuaucaaaccaaauacugugaacguaccagguguuuacagauuuaaaugcauguuacca

SEQ ID NO: 999 - RNA, 62 nt, Human
aguuucaagcaacuccaaaauugaaugugacaaacaguauuaaaccuuaagccucaagacgu

SEQ ID NO: 1000 - RNA, 62 nt, Human
aguuucauuacagggaaggaacccaugaaaacaucaguguuaagagcaugaugaaagguguc

SEQ ID NO: 1001 - RNA, 62 nt, Human
aguuucccauucuguaaaucagagaucaugcaugcuaccucaaagguuguugugaacauuaa

SEQ ID NO: 1002 - RNA, 62 nt, Human
aguuuccucugcucagcaucauuucaugccaaagugcugcuaugggcugcuuugugugcaca

SEQ ID NO: 1003 - RNA, 63 nt, Human
aguuucucgacuuguauuuauuaaauacucaaacucaguauuaccuacucaaugccuuuuaaa

SEQ ID NO: 1004 - RNA, 63 nt, Human
aguuucugggugccccacuaaguagaauaaagaaaaacgguuauguggugguggcagcugggc

SEQ ID NO: 1005 - RNA, 62 nt, Human
aguuugagaccagugugcaaaacauagcaagaccucaucucagaaaaaaaaaaaaagucauu

SEQ ID NO: 1006 - RNA, 62 nt, Human
aguuugaguuaggagcuuuuaccuuguagcagagcaguauuaacaccuaguugguucaccug

SEQ ID NO: 1007 - RNA, 62 nt, Human
aguuugcacuccaguagaagacagaaggaacguauguuuacaaaccacuucacuggaagacg

SEQ ID NO: 1008 - RNA, 62 nt, Human
aguuugcccaccugugaaauggggcugauaccaccuaccucacugaagucccaggguucaag

SEQ ID NO: 1009 - RNA, 62 nt, Human
aguuuggacauacauaaggagagaagguacagugaugaaggagaccauaauucuguaguguu

SEQ ID NO: 1010 - RNA, 62 nt, Human
aguuuucauggagaaaagcaccuggcuccagggccaguguuacaguguuacccuguaaggug

SEQ ID NO: 1011 - RNA, 62 nt, Human
aguuuucuacaacaaaaaaagaguugagugaaucuguuuacauuuagaauaauguuuuuuuc

SEQ ID NO: 1012 - RNA, 62 nt, Human
aguuuugggagcauugagccugccuagaaagauacaguguuagcuccccuuacuucaaaguu

SEQ ID NO: 1013 - RNA, 62 nt, Human
aguuuuuaagggcuuuauuauagaagaaguauuaaugaaggacuuuccuuccucccucccuu

SEQ ID NO: 1014 - RNA, 62 nt, Human
aguuuuuacauuuuggucuaaaaagcucuuggauucaucucaucucauggaaugauccuguc

SEQ ID NO: 1015 - RNA, 64 nt, Human
aguuuuuauagaccugagguuccagugucuccugguaacuggaaccucuccugagggggaaucc

SEQ ID NO: 1016 - RNA, 61 nt, Human
auaaaaaguuauccauuggggagcuccauuuucccugcugagugagcuagauugccuuccc

SEQ ID NO: 1017 - RNA, 62 nt, Human
auaaaaauuacacuuuuuuuuuugguuuauuccccaguauuaaaaacaaagcaagcugaguc

SEQ ID NO: 1018 - RNA, 62 nt, Human
auaaaaggaaaaccagugaagugccacaugacagcaguguuaaguguuugaaaacguuucaa

SEQ ID NO: 1019 - RNA, 63 nt, Human
auaaacugaaaaaugucagucugguuuauauaaggcaguauuauugagcucuauuuccccacc

SEQ ID NO: 1020 - RNA, 63 nt, Human
auaaacuucuguaaccuaugcauauuuuaugggggcaguauuauuacaaauggaucugaaaug

SEQ ID NO: 1021 - RNA, 63 nt, Human
auaaagcaugacucaucucguccugcccaccccucacacuggacuauaaauacccucccuggg

SEQ ID NO: 1022 - RNA, 63 nt, Human
auaaagcgucguaagaugguugggaagaaccagaggugacuuaugcaaaagcuuuauaaacug

SEQ ID NO: 1023 - RNA, 62 nt, Human
auaaauggggaucucugaaaccuuccuacccuaccuaccucacagggcuguugugaggaccc

SEQ ID NO: 1024 - RNA, 63 nt, Human
auaaauggucucagguuuaauuuguaauacgacaaacacuggaagauauaacccacaggaaau

SEQ ID NO: 1025 - RNA, 61 nt, Human
auaaauguaauaaguaaauauuuauuuaggaauacugugaacacugaacuaauuauuccug

SEQ ID NO: 1026 - RNA, 63 nt, Human
auaaauguauuaaaauuaaauucauucucuuauuggugacuuauggaaauaaagcaucaauau

SEQ ID NO: 1027 - RNA, 62 nt, Human
auaaauucauaaugcuuuuuuggguacacugaaauguuuacauacugaauucuguaauauga

SEQ ID NO: 1028 - RNA, 63 nt, Human
auaaauuccaauuucuauuuacuuauucauugugacaguauuacuaaacagguaaggauggga

SEQ ID NO: 1029 - RNA, 63 nt, Human
auaacagacauuuuuguuauacauuagacuaucagacacuggaccuaccuuaaugguuagaca

SEQ ID NO: 1030 - RNA, 61 nt, Human
auaacauaauuuuacaaucugcaugugaauuuaacugugaaauucaguauugugauauuuu

SEQ ID NO: 1031 - RNA, 63 nt, Human
auaacauguuaggcucacacaugcaucagcacugcacacuggaaucauugcucuuccuggacu

SEQ ID NO: 1032 - RNA, 61 nt, Human
auaaccaaguuuuugaacgcugcuaugaauugcacugugaaaagcacucuucccucucagu

SEQ ID NO: 1033 - RNA, 62 nt, Human
auaaccccaggagaaccaaagaaaaucuagaaguugcugcuaaaaacaguuauguuagugau

SEQ ID NO: 1034 - RNA, 62 nt, Human
auaacuauguaacuuucucguaauguaucuguuugugcaauauggaagcugugaguggauuc

SEQ ID NO: 1035 - RNA, 64 nt, Human
auaagaguguuuuuguuuaccugugggccuugggccaugcaguaucagcuugaccuugcaaggu

SEQ ID NO: 1036 - RNA, 62 nt, Human
auaagccaauuuuucugcacugagcagagucuugcuaccucagucaguauuguuuugguuug

SEQ ID NO: 1037 - RNA, 63 nt, Human
auaagcugcuaauuguaaacaaaacaguuacccuccaguauuaauaugacucauuagugugag

SEQ ID NO: 1038 - RNA, 64 nt, Human
auaaguauauuauuaauuguacuuuuauguaauaaaaugcaguauauuuaagcuuuauuuauuu

SEQ ID NO: 1039 - RNA, 62 nt, Human
auaagucgggguuuggucucagcauuuacaaauguguuuacagucagaaugaaacacauucc

SEQ ID NO: 1040 - RNA, 64 nt, Human
auaauaaacuaauuuaagaagugauaaagucuccagaugcaguagcucacacuguaaucacagu

SEQ ID NO: 1041 - RNA, 62 nt, Human
auaaucaaaacaccgcguaggcuccuccguuuaucaguauuaaugguguaacuuuguuggca

SEQ ID NO: 1042 - RNA, 62 nt, Human
auaaucaagguaucuugaugguuauaugugguauuguuuacacuguuaauauccacauguaa

SEQ ID NO: 1043 - RNA, 62 nt, Human
auaaucauagcagcacuuuucacagcaucagcagucaucucacuaguuauguucaaaaaagu

SEQ ID NO: 1044 - RNA, 61 nt, Human
auaaucucaccaugcugaauugugaaugaauuaugagauuaauagacccucaaaugcuagu

SEQ ID NO: 1045 - RNA, 62 nt, Human
auaaugaugaguaacuuaaccagcacauuucuccuguuuacacucgggggauuuuuuuguuu

SEQ ID NO: 1046 - RNA, 64 nt, Human
auaauguauaauuuuuauguauuuuucaaaacuacaaacuggaauccaacuauaaaguguuuaa

SEQ ID NO: 1047 - RNA, 63 nt, Human
auaauguuuugggaaacacugaaaugaaaucuucccaguauuauaaauuguguauuuaaaaaa

SEQ ID NO: 1048 - RNA, 64 nt, Human
auaauuaagaaagguaggauucagugcuuaccgaugaugcaguacuugauagaagaaaacaguc

SEQ ID NO: 1049 - RNA, 61 nt, Human
auaauugaucaaaaagaacagaacccucuccagccugcugacccaaacccaaccacacaau

SEQ ID NO: 1050 - RNA, 61 nt, Human
auaauuuacaaaaaaaaaaagucucgucugagaacugugaacuguggaagaaaucaaaacu

SEQ ID NO: 1051 - RNA, 62 nt, Human
auaauuucuauucaauauugcuagauauauuaacaugaaggaauggggaagcuuauuucaau

SEQ ID NO: 1052 - RNA, 62 nt, Human
auaauuuggucauuuggcagccccuguuuucugcuguuuacaacaucaccagugccacguca

SEQ ID NO: 1053 - RNA, 61 nt, Human
auaauuuuugagacuugaaaaauaccccgaccuugagauuauuccuguuugaaagguggug

SEQ ID NO: 1054 - RNA, 62 nt, Human
auacaaaucuuuuagguaguagaguuuaacguguauaagcuaaaagugaaaguaacugagug

SEQ ID NO: 1055 - RNA, 63 nt, Human
auacaacuccagccucauuaaacaucggagaauucacacuggagagagaccuuaucagugcag

SEQ ID NO: 1056 - RNA, 63 nt, Human
auacaauauuuauaacuauaaacuuuauagaaguacaguauuaaagucagugguacacagaca

SEQ ID NO: 1057 - RNA, 63 nt, Human
auacacauuuauuuuuucauuuagauacuuuccuucaguauuaugauugagacauuaaccuca

SEQ ID NO: 1058 - RNA, 61 nt, Human
auacacugaaguugugucguuuuugccacuagaugagauuaaaagaagacaauuauucaaa

SEQ ID NO: 1059 - RNA, 62 nt, Human
auacagaaaugcaaaucaaaaccacaaugagauaucaucucauccuaauuaaggugacuauu

SEQ ID NO: 1060 - RNA, 62 nt, Human
auacagauguacuagcuaaagucucuuuaugugucaguauuaagaguaauauguagccagau

SEQ ID NO: 1061 - RNA, 62 nt, Human
auacaggaaauggcucuuguuuauuuuuuugcuguguuuacagcuuguuaaugcucuacugu

SEQ ID NO: 1062 - RNA, 62 nt, Human
auacaguacuguuucuggacccuuauaaaauccugugcaauagacacauacaugucacauuu

SEQ ID NO: 1063 - RNA, 63 nt, Human
auacauccuggguaaugagagguggcuuuugcggccaguauuagacuggaaguucauaccuaa

SEQ ID NO: 1064 - RNA, 61 nt, Human
auaccaaugugaaaauccacucuuuuauuauguugagauuaucuucugaucaggaaguuug

SEQ ID NO: 1065 - RNA, 62 nt, Human
auacccaucuguaauacagguccugucauuucauucaucucaaauuauuuugaauucuuccc

SEQ ID NO: 1066 - RNA, 62 nt, Human
auaccucauuuuuaaaaagaaguuuucauggcaucaguguuaauaaaguacauuuuuaacug

SEQ ID NO: 1067 - RNA, 62 nt, Human
auaccugagauuggagcaccuacaauagaagguacaguguuacaucucaguggacuauggua

SEQ ID NO: 1068 - RNA, 63 nt, Human
auaccuuuucagaaaccugcuuucauuugcuuagccaguauuagaacagaucuuuacaacagc

SEQ ID NO: 1069 - RNA, 62 nt, Human
auaccuuuuuaaaguuaaauaucacuagaaaaaucaguguuauuacaagggaagaaaugaac

SEQ ID NO: 1070 - RNA, 62 nt, Human
auaccuuuuucuaugaaaaaagacccagcgccgugugcaauaaagguuauguuucucccgca

SEQ ID NO: 1071 - RNA, 63 nt, Human
auacgaauuguuucacaaacagaaaacauguaaagcaguauuaaaauuuggccaaacaagugu

SEQ ID NO: 1072 - RNA, 63 nt, Human
auacuagaagaaaauggaggaaaacgacauuauaugugacuuaaaaccuagaagaaauaaaua

SEQ ID NO: 1073 - RNA, 61 nt, Human
auacuaugucaaauaugcauuuaauacaccuacccugcugaacaucauagccgaucuugcc

SEQ ID NO: 1074 - RNA, 62 nt, Human
auacuccugacuuguaauaagaagacaucagagaugcugcuaagucggcuccagcacacagg

SEQ ID NO: 1075 - RNA, 64 nt, Human
auacugauaccuacagcuacagaaagcaggacuaggaacuggaaauaacuuuggguccugccuu

SEQ ID NO: 1076 - RNA, 62 nt, Human
auacugggacauauuuaaauacugaguauaguacugcugcuacugcuucuacaauguaaaau

SEQ ID NO: 1077 - RNA, 62 nt, Human
auacuguacuuccuggucaguggccagaggaugcgugcaauagcagaggccaggugaccccu

SEQ ID NO: 1078 - RNA, 62 nt, Human
auacuguguuuacacagguauaagucaguaauagcaguguuaauauuuacaggauuuuggcu

SEQ ID NO: 1079 - RNA, 64 nt, Human
auacuuucagggguggcccaaugagggaauccauugaacuggaagaaacacacuggauugggua

SEQ ID NO: 1080 - RNA, 62 nt, Human
auagaaaguuugcugaaagcaaagggcuaagcuuaugaaggaaugccuccuuuguuacacac

SEQ ID NO: 1081 - RNA, 62 nt, Human
auagaagccccuccccagggccccacccugccauaugaaggaccccacccccgacaccacaa

SEQ ID NO: 1082 - RNA, 62 nt, Human
auagaaggggggcuauuuuaaaugucaaggucagcaguguuacuuugaauguaaacugguau

SEQ ID NO: 1083 - RNA, 63 nt, Human
auagaaguuuugccucaccaaauaccagaagggucacacuggagaaagacccuauaguuaugg

SEQ ID NO: 1084 - RNA, 61 nt, Human
auagacagacacuguuaaaauuuuggcauauuuccugcugauuuuuucuacugcugauuuu

SEQ ID NO: 1085 - RNA, 62 nt, Human
auagacaucaguauucugccaucauuuuugaugacuaccucagaacauaaaaaggaacguau

SEQ ID NO: 1086 - RNA, 62 nt, Human
auagaccaguauuucugacagguaaaaugcuaaaauaagcuaccuguaauaaguguggauua

SEQ ID NO: 1087 - RNA, 62 nt, Human
auagacuguacaucaaauuagaguauuauuucuucaguguuauuguuuucagagccacauuu

SEQ ID NO: 1088 - RNA, 64 nt, Human
auagacuguugguaacuucacuagagcauacauaacaacuggaacuggaaauuauacaaaagua

SEQ ID NO: 1089 - RNA, 61 nt, Human
auagagcuggagacuacuuuugugcuuuacaaaacugugaaggauuguggucaccuggaac

SEQ ID NO: 1090 - RNA, 62 nt, Human
auagaguagaagauuugaugcuggagagguuaaggugcaauaagaauuuagggagaaauguu

SEQ ID NO: 1091 - RNA, 61 nt, Human
auagauauguaaaauguggauuauguugcaaauugagauuaaaauuauuugggguuuugua

SEQ ID NO: 1092 - RNA, 62 nt, Human
auagcauguucauuaggggauuccuuccucccccucaucucacaggggaagggagaggaaag

SEQ ID NO: 1093 - RNA, 63 nt, Human
auagccaaaccauaucacuggugaugccacuucuucaguauuagggauucucagucagaagag

SEQ ID NO: 1094 - RNA, 63 nt, Human
auagccauaagaaaauaucugcuauacaggaaaaccaguauuaagcaaauaccaccauccuua

SEQ ID NO: 1095 - RNA, 63 nt, Human
auagccuaggaaauuuaacauauauauaacuauagcaguauuaauaaugauaguuguacuucu

SEQ ID NO: 1096 - RNA, 62 nt, Human
auagcggcccucccccaggcgacaaggaccaaggugcugcuaaggccacucuagcgcccaga

SEQ ID NO: 1097 - RNA, 61 nt, Human
auagcuggagucuuuugugcaauuguuucucacccugcugauucugugguaucuguguuga

SEQ ID NO: 1098 - RNA, 62 nt, Human
auaggaaaaaugacccaacauuucuuagcaugagcuaccucaucucuagaagcugggaugga

SEQ ID NO: 1099 - RNA, 62 nt, Human
auaggacaaaggcccuggcugugcccaaaagggucuaccucaggugggguuacaagcaaacc

SEQ ID NO: 1100 - RNA, 62 nt, Human
auaggcaauagaaauuaaguaauccaaaagaggauuccguuauucacuaaaguaucuuccuu

SEQ ID NO: 1101 - RNA, 62 nt, Human
auaggcacauuaccauucauaguaagaauucugguguuuacacaaccaaauuugaugcgauc

SEQ ID NO: 1102 - RNA, 63 nt, Human
auagggcaguggcuauucacagaugugaugauagcacacuggagccucaaacucuuaggcuca

SEQ ID NO: 1103 - RNA, 62 nt, Human
auaggggauuagccccagaagggacugagcuaaacaguguuauuaugggaaaggaaauggca

SEQ ID NO: 1104 - RNA, 62 nt, Human
auagguaaaauauuacucuguuuacagcaaaaggcuaccucauaguugauacauagcacacc

SEQ ID NO: 1105 - RNA, 62 nt, Human
auaguaauuguuuauauucauaauuauucagcucugcugcuaaacacguaguuccacuucgu

SEQ ID NO: 1106 - RNA, 64 nt, Human
auaguauauguaucugcauaaugucugaagucauuaaugcaguaacaggucaagcucuuuagca

SEQ ID NO: 1107 - RNA, 62 nt, Human
auagucagcugccuuuuaagaggucuuaucuguucaguguuaagugauuuaaaaaaauaaua

SEQ ID NO: 1108 - RNA, 62 nt, Human
auagucaugauagugaguauucuuacacuguucccaguauuacagggaaugcuuagaaauuu

SEQ ID NO: 1109 - RNA, 62 nt, Human
auaguuacaaaauacaaaaguucaaccucuuacaauaagcuaaacgcaaugucauuuuuaaa

SEQ ID NO: 1110 - RNA, 64 nt, Human
auauaaauauggugucuguguacauauagugaagauaugcaguaagagcuaccuuaaagacuuu

SEQ ID NO: 1111 - RNA, 63 nt, Human
auauaaauauuuggucucuauuucauuuuuugcaucaguauuaauacuaaaauaugucucgcu

SEQ ID NO: 1112 - RNA, 63 nt, Human
auauaagaauucuuuuggaaauuagagguggaaacacacuggaaccucaugauaauugacccu

SEQ ID NO: 1113 - RNA, 64 nt, Human
auauaaguucucuuugcguaggccacuggguuucucaugcaguaagcuuuauaaaaacucauuu

SEQ ID NO: 1114 - RNA, 64 nt, Human
auauaaucaaaauucaaagauuuuuuuuguuucuguaacuggaacuaaaucaaaugauuacuag

SEQ ID NO: 1115 - RNA, 62 nt, Human
auauaaucacuccuguccuaauucuuggugauuucaguauuacaaagaugauccucccaaca

SEQ ID NO: 1116 - RNA, 62 nt, Human
auauaaugaacuuuguacuauucacauuuuguaucaguauuauguagcauaacaaaggucau

SEQ ID NO: 1117 - RNA, 63 nt, Human
auauaaugcauaucuggcaaaacauacuagaauucacacuggagagaaacucauuauaagugu

SEQ ID NO: 1118 - RNA, 63 nt, Human
auauaauuuaguuuaaauuuauguaucaccucauugugacuuauuuuuuccauuauaccauua

SEQ ID NO: 1119 - RNA, 62 nt, Human
auauacaugaacuuuuuucauggcauuauguggauguuuacaauggugggaaauucagcuga

SEQ ID NO: 1120 - RNA, 64 nt, Human
auauauacauaaggaaccccugaaagaugguuuuggaacuggaaucaguuagaggaugaaauca

SEQ ID NO: 1121 - RNA, 62 nt, Human
auauauauauauauauauauauaugguauaggagauaagcuauuucuuuccaaaaucuauaa

SEQ ID NO: 1122 - RNA, 62 nt, Human
auauauauggaguacaaugugauguuuugauauauguuuacaguguagaaugauuaaaucaa

SEQ ID NO: 1123 - RNA, 63 nt, Human
auauaucaguuuuuuuccccuucggucuuccacagcaguauuauugucuuuguggaguugacu

SEQ ID NO: 1124 - RNA, 62 nt, Human
auauauccaguuuucauuuuuuuacgucuugccuauaagcuaauaucauaaauaagguuguu

SEQ ID NO: 1125 - RNA, 62 nt, Human
auauaugaaauuaauuaggcucuaguccaacaguuguuuacauuuuaaauaguccauauuga

SEQ ID NO: 1126 - RNA, 62 nt, Human
auauauguauagugaacauauugcuuaguaacaaaugaaggacaagcauacuacauaauaua

SEQ ID NO: 1127 - RNA, 64 nt, Human
auauauucuuuguguuuauuuaaaaguuuugaaaauaugcaguacuguuuauauuuuguauacc

SEQ ID NO: 1128 - RNA, 62 nt, Human
auauauugggugugaguucagguugccucucacaaugaaggaaguuggucuuugucugcagg

SEQ ID NO: 1129 - RNA, 64 nt, Human
auaucaaauaacuuauucacuuuucauguggcaggaaacuggaauaucgcuuuuaauaaaaugg

SEQ ID NO: 1130 - RNA, 64 nt, Human
auaucaagaaacaggacaaaguuaagagcaaucacaaacuggaauaucgccuuaaaaaucaaac

SEQ ID NO: 1131 - RNA, 62 nt, Human
auaucaccucucaaaagcaucaccucuaucugccucaucucacacuguacucuccaauaaag

SEQ ID NO: 1132 - RNA, 64 nt, Human
auauccuagaaucccagguuuagguaaagaguugcaaacuggaacucauaaauuaucauagucu

SEQ ID NO: 1133 - RNA, 62 nt, Human
auaucuaucauaugaccccugcacucccucuguaucaucucaggagguuucaggggccuguu

SEQ ID NO: 1134 - RNA, 62 nt, Human
auaucucuacacguauauuuuuacauuaaaaauacaguguuagcauaaauccccuuuucagg

SEQ ID NO: 1135 - RNA, 61 nt, Human
auaucuucagaaaaccuaagcaaacuuacagguccugcugaaacugcccacucugcaagaa

SEQ ID NO: 1136 - RNA, 63 nt, Human
auaugaaacauuuuuaagacaaaggcauuacuucucaguauuaccaaaccuaaacugguugaa

SEQ ID NO: 1137 - RNA, 62 nt, Human
auaugacaacugguaaugguggauucauuuacauuguuuacacuucuaugaccaggccuuaa

SEQ ID NO: 1138 - RNA, 62 nt, Human
auaugagaauguuuugcguaggggcaacacagucugcugcuauauagugggggaagcgugca

SEQ ID NO: 1139 - RNA, 62 nt, Human
auaugauauguacuuuuaaguuuuaguugcuucauguuuacauucagcuguucaacauaauu

SEQ ID NO: 1140 - RNA, 62 nt, Human
auaugauugugacuucuaguucuuuucuagaggaugcugcuagaaaaugguuuugcuuugua

SEQ ID NO: 1141 - RNA, 62 nt, Human
auaugcagcauuaacuuuacugacauggagugaagugcaauauuauaaauauuauagauuaa

SEQ ID NO: 1142 - RNA, 63 nt, Human
auaugccaaauauauauugcuauaauacacucaagcaguauuaaucaauaugguaucacaaug

SEQ ID NO: 1143 - RNA, 64 nt, Human
auaugcuuccugccauugcgcaaucugagccugagcaacuggaaacccccauuucucauuagug

SEQ ID NO: 1144 - RNA, 62 nt, Human
auaugcuuugauugaugcagcauuaugcuuugggcaguauuacaaaauagcuggcgagugcu

SEQ ID NO: 1145 - RNA, 63 nt, Human
auauggccccucuuaaccaugcugguguuaugauucaguauuaacucucaauuagcaugcccc

SEQ ID NO: 1146 - RNA, 61 nt, Human
auauguaacuacggagcuguagugccauuagaaacugugaauuuccaaauaaaucugaaca

SEQ ID NO: 1147 - RNA, 63 nt, Human
auauguaagguagggucuuuuuugcauauagacuccaguauuaguuacuuucauucuaaaauu

SEQ ID NO: 1148 - RNA, 61 nt, Human
auauguuaauaaaauaauuuuuauggcaauacaacugugaaauaauaaggccgauuuucau

SEQ ID NO: 1149 - RNA, 63 nt, Human
auauguucguuuaucauuucagaaauugcuguaacacacuggaaaauuccugaacaauauaga

SEQ ID NO: 1150 - RNA, 64 nt, Human
auauguuucagacacucucugcccagacucauuuuuaacuggaaaucaucacagcagugggaua

SEQ ID NO: 1151 - RNA, 63 nt, Human
auauuaccagcuagccagucacuaggaauuuuuuucaguauuauuuguauguauuaaacuuuu

SEQ ID NO: 1152 - RNA, 62 nt, Human
auauuaugagucaaucuaguugguuuuauucgacaugaaggaaauuuccagauaacaacacu

SEQ ID NO: 1153 - RNA, 62 nt, Human
auauucucuaguauauagcuacaccuuuaauaaaaugaaggaaugucuucaaucauauuuua

SEQ ID NO: 1154 - RNA, 63 nt, Human
auauucuugguguuuagcuggcucgaugauguuaacaguauuaaaaauuaaaccccauaaacc

SEQ ID NO: 1155 - RNA, 62 nt, Human
auauugagagauagauuuuacucugauuagaaagaugaaggagggauuuggggauaaacaau

SEQ ID NO: 1156 - RNA, 61 nt, Human
auauugcugauggggguaucaauugguauauccacugugaaaaaccauucacuagaaaagu

SEQ ID NO: 1157 - RNA, 62 nt, Human
auauugcuggauuugcuaccuuugguuacuugugcaguguuaaaaguaauccacuuucuugu

SEQ ID NO: 1158 - RNA, 64 nt, Human
auauugguaguuuuauuacuauaguaaaucaaggaaaugcaguaaacuuaaaaugucuuuaaga

SEQ ID NO: 1159 - RNA, 63 nt, Human
auauugguauuuugaauguuaaaugucaaacaaaugugacuuaugcuggugcccucgcccugc

SEQ ID NO: 1160 - RNA, 61 nt, Human
auauuguuuguucacucauuuagucauuaaaagugagauuaauaaaaucugaaaauguuau

SEQ ID NO: 1161 - RNA, 62 nt, Human
auauuuaauccuuaaaaccccuuuaaaugagggccaguauuaucucugcuuucagaaguaga

SEQ ID NO: 1162 - RNA, 63 nt, Human
auauuuacaguccucaaacaugguuauuucugucagugacuuaacauucgguuuuaucagcca

SEQ ID NO: 1163 - RNA, 62 nt, Human
auauuuacuugaguaaggaacacuuuugugcguacaguauuauuuggcuucuucaguugugc

SEQ ID NO: 1164 - RNA, 62 nt, Human
auauuuauauuuugccuguuaaaaagaaagugagcaguguuagcuuaguucucuuuugaugu

SEQ ID NO: 1165 - RNA, 62 nt, Human
auauuucucuuuucuguuuaugaaguacaacccaugcugcuaagaugcgagcaggaagaggc

SEQ ID NO: 1166 - RNA, 61 nt, Human
auauuuuaaaaggagaauuuaaauacugugcuuacugugaaauauaucaguuggugagccg

SEQ ID NO: 1167 - RNA, 61 nt, Human
auauuuuauuggagaucauuaacuccuagaauuugagauuauauuuccauacaacauuuua

SEQ ID NO: 1168 - RNA, 63 nt, Human
auauuuucaggcaccauuuugacagcauucaggaaaacgguuauugaccccauagacuagggu

SEQ ID NO: 1169 - RNA, 63 nt, Human
auauuuuucaucuucaaacacaguacaaaaauuaccaguauuaccauaacugagauaaagauc

SEQ ID NO: 1170 - RNA, 64 nt, Human
auauuuuucuguguacaauuauaggauuguaaucuaaacuggaauuuuuaggcaguaagucacc

SEQ ID NO: 1171 - RNA, 62 nt, Human
auauuuuugacacaauuaaauauuacauagaguauguuuacaacaaauauccugucagccaa

SEQ ID NO: 1172 - RNA, 62 nt, Human
aucaaaaauggaaacaaucugagagacaggaaaagugcaauauuaccaagauggaugccagg

SEQ ID NO: 1173 - RNA, 64 nt, Human
aucaaacauuuugguuuaaaaaacaugauuauuuaaaacuggaaacuaaaaagaaucaaauuga

SEQ ID NO: 1174 - RNA, 61 nt, Human
aucaaagcccuuaaauucucaagacuaaagacuugagauuauauaaaauuauccagaauca

SEQ ID NO: 1175 - RNA, 62 nt, Human
aucaaggauuuucauguugaugacucgaaacugacaguauuaaggguaggauguugcuucug

SEQ ID NO: 1176 - RNA, 62 nt, Human
aucaaguauuggcaaagauguggggaaaauucucauaagcuacugaugagaauuuauaaauu

SEQ ID NO: 1177 - RNA, 61 nt, Human
aucaaguuuauaauuuuggcaaauuguuaagacacugugaagucagcguuaaccaugugca

SEQ ID NO: 1178 - RNA, 63 nt, Human
aucaaucacagcuuguauuuugugaagacugggaagugacuuagcagaugcuggucauguguu

SEQ ID NO: 1179 - RNA, 62 nt, Human
aucacaauuaaaauucugacaguugccuuuuuuuucaucucaaauggcagcaugggacugaa

SEQ ID NO: 1180 - RNA, 62 nt, Human
aucacaguguuuuuauugcucgcccagacaccaugugcaauaagauugguguucguuuccau

SEQ ID NO: 1181 - RNA, 61 nt, Human
aucacccaacauggugaaagggugauggauuucacugugaauaugccaaggacaccucuaa

SEQ ID NO: 1182 - RNA, 62 nt, Human
aucacuaaguaauagacccacagcuuuauucuuguguuuacauuacccuugaaauguuuuca

SEQ ID NO: 1183 - RNA, 63 nt, Human
aucagccucgcaccuucaaaugcauggaaggacucacacuggagaaaaacccuaugaauguaa

SEQ ID NO: 1184 - RNA, 62 nt, Human
aucagcuagcaaaagaaguaacaagagugauucuugcugcuauuacugcuaaaaaaaaaaaa

SEQ ID NO: 1185 - RNA, 62 nt, Human
aucaggaacagcuaugggagccccagggucuucccuaccucaggcaggaagggcaggaagga

SEQ ID NO: 1186 - RNA, 62 nt, Human
aucaguauacaucuagagaggaaaugcaaugugacaguguuacauuuggagagaagugugaa

SEQ ID NO: 1187 - RNA, 62 nt, Human
aucagugcuuugguacuuuugauuaccuguguuucaguauuagugucacuuuaguacuucag

SEQ ID NO: 1188 - RNA, 61 nt, Human
aucaguuuguacaaggacacuaagacaguguagccugcugacuugagaauguucuguaagg

SEQ ID NO: 1189 - RNA, 62 nt, Human
aucauacauacaccacauagauaguuugccaagaaugaaggaggcuuuuuugaaugaaacca

SEQ ID NO: 1190 - RNA, 63 nt, Human
aucauagcuuguuuuauuuugugcuauaaaauuaacaguauuaaaugacuuauauucuuagaa

SEQ ID NO: 1191 - RNA, 64 nt, Human
aucauccacuuucuucuaaaauaaagagaagaaaauggccaguauucauccuguccuucucuuu

SEQ ID NO: 1192 - RNA, 62 nt, Human
aucaucugagaccagccaguagucacagaacugcuguuuacacaguucucaggaggcugugg

SEQ ID NO: 1193 - RNA, 62 nt, Human
aucaugaaacucuuuagcuugauuagaugguaaacaguguuaacccauccuuuacuacagag

SEQ ID NO: 1194 - RNA, 62 nt, Human
aucaugagacaugcuucuuugguuuauaaugagauguuuacaguuaaauacagauggcaguu

SEQ ID NO: 1195 - RNA, 62 nt, Human
aucaugaguggguauuuugauucuaugguucccucaguauuacaucuugacuuguaaucaau

SEQ ID NO: 1196 - RNA, 62 nt, Human
aucaugauaaugaacguauccaucaccugcaaagcuaccucaugccccuuuacauucccucc

SEQ ID NO: 1197 - RNA, 61 nt, Human
aucaugucaaggugcauacuuagugagcgccauccugcugaacguguauuucaguguuuca

SEQ ID NO: 1198 - RNA, 61 nt, Human
aucaugucaguucuugaauggguaucuccuuagccugcugauuucuuuuucuuucuaaaga

SEQ ID NO: 1199 - RNA, 62 nt, Human
aucauguuccuaaaagaugcucauggggagaaaauguuuacagacaaauaauuuugggagcu

SEQ ID NO: 1200 - RNA, 62 nt, Human
aucauucaaauuauguuaaauccaacucaacuuuauaagcuaaggaacaugugaaggauaaa

SEQ ID NO: 1201 - RNA, 64 nt, Human
aucauuugaguauacauaauucaaaagaacuacuugaugcaguauagucuuaaggguucugcau

SEQ ID NO: 1202 - RNA, 61 nt, Human
aucauuuucaggcuucugcagcuguagauucucacugugaaucccuugcuugcucaugcau

SEQ ID NO: 1203 - RNA, 63 nt, Human
auccaaacugauuaaguuacaguuuaagcacccuucaguauuaauauauacgguauuauauaa

SEQ ID NO: 1204 - RNA, 62 nt, Human
auccaagacaacagggugcacugcugccuguacuucaucucacccuucggccaugggcuccg

SEQ ID NO: 1205 - RNA, 62 nt, Human
auccaaguugauuuuugugucuacagcuaaauuuuguuuacaauuaggcuauuuuuuaauau

SEQ ID NO: 1206 - RNA, 61 nt, Human
auccaaugucuagaaaucaggcccuuuggacauccugcugacacuugggccccuuaacacc

SEQ ID NO: 1207 - RNA, 62 nt, Human
auccaccugugacgccguggagcaggaucuucauucaucucaccagagcaacagcccagucc

SEQ ID NO: 1208 - RNA, 64 nt, Human
auccaucauaauuuuugcuguugauuugaacauuaaaacuggaauugugcuaaaaucagacuug

SEQ ID NO: 1209 - RNA, 62 nt, Human
auccauuucgauugugugacagauugaaauuuauuguuuacauuggggaauguaucucaaau

SEQ ID NO: 1210 - RNA, 62 nt, Human
aucccagaggcugaggguuggggagaggaagccaucaucucauuaccucugucagugcaggg

SEQ ID NO: 1211 - RNA, 64 nt, Human
aucccauuggagguaaauuguagcuucuucucauucaugcaguaaauaauacauccuuucacuc

SEQ ID NO: 1212 - RNA, 62 nt, Human
auccccuuuacaagaaaaucgaaaacacagaagaaugaaggacaugccaguccccgaucgcu

SEQ ID NO: 1213 - RNA, 63 nt, Human
auccuacagaugaccucugcuacaauaaguacgaugugacuuaguaacugcauagcaguugga

SEQ ID NO: 1214 - RNA, 61 nt, Human
auccucauucaaaagcacuggacagagaauguuacugugaauagagcacauauuacucuuu

SEQ ID NO: 1215 - RNA, 63 nt, Human
auccugauugcugauaguguuuuaugcagacucuugugacuuauacucaccacagaauggauu

SEQ ID NO: 1216 - RNA, 61 nt, Human
auccugucauuuagaacagugaaaaguaucuuuugagauuaaagugacucuuuacuguagg

SEQ ID NO: 1217 - RNA, 63 nt, Human
auccuugcugggguuucuacaguccccaacgugaacaguauuaagcaagagguggacucgagc

SEQ ID NO: 1218 - RNA, 63 nt, Human
auccuuggcaauaacuuuguguauuauguuuaaaaacacuggaaaccgugaccaccauggacu

SEQ ID NO: 1219 - RNA, 63 nt, Human
auccuuucacgaccuuggccucuaaggcuucacccacacuggacuuuacagaaagauaacgcc

SEQ ID NO: 1220 - RNA, 64 nt, Human
auccuuuuuuguuccuuuuuccugcugccauacuguaugcaguacugcaagcuaauaacguugg

SEQ ID NO: 1221 - RNA, 62 nt, Human
aucgacagaacaguccuuaauccagaaaccugaaaugaaggaagaggagacucugcgcagag

SEQ ID NO: 1222 - RNA, 62 nt, Human
aucgcuaaaggaaaauacaguaagugcuugaaagaugaaggaccaaaaggccaaaaaacagu

SEQ ID NO: 1223 - RNA, 62 nt, Human
aucguaugaagacagauuuugucuuuuucuugccuguuuacacucuaucuuacagagguuuc

SEQ ID NO: 1224 - RNA, 63 nt, Human
aucguuaguucuucuucaaaaggaaauugcaucuugugacuuaguagacugaugaugauaucc

SEQ ID NO: 1225 - RNA, 62 nt, Human
aucguucauuuaccaucuuuaggaucauugaaacucaucucacuaaagaaaguucacuugaa

SEQ ID NO: 1226 - RNA, 62 nt, Human
aucuaaauuaacuucuauuuucaaguggaaaccuugcugcuaugcuguucauugaugacaug

SEQ ID NO: 1227 - RNA, 61 nt, Human
aucuaaggaagaacuugcugcugcaguauugaaacugugaagaacugacauuugaagaaaa

SEQ ID NO: 1228 - RNA, 62 nt, Human
aucuacagaguguuucgugaucucuccuucuccaucaucucaucucuggaugcuguggugcc

SEQ ID NO: 1229 - RNA, 63 nt, Human
aucuaccucacaccuucgaaaacaugguaggacucacacuggauagaaaccaaagcaggugaa

SEQ ID NO: 1230 - RNA, 61 nt, Human
aucuagcuggagccccgcagggaggggcaugguccugcugaaucccguagccagucuagac

SEQ ID NO: 1231 - RNA, 62 nt, Human
aucucaaaaaaaaagaaaauuuccaagcaugguaucaucucacuuuucuaauuuacaggcug

SEQ ID NO: 1232 - RNA, 62 nt, Human
aucucaaacuucagacauuccagaauugucaugauguuuacacugucugaguuaaaaauccu

SEQ ID NO: 1233 - RNA, 62 nt, Human
aucucaaccacaguuuuuguguuuacuuaaacugugcugcuaaguagggcuagggcaaaaaa

SEQ ID NO: 1234 - RNA, 63 nt, Human
aucucacccccauguuaaauuuuuucuguugaacuacacuggaucugacuugauagaacuauu

SEQ ID NO: 1235 - RNA, 64 nt, Human
aucucaggcguggcuucuucaguggaccaagcugcaaugcaguauugacuugacagagccucua

SEQ ID NO: 1236 - RNA, 62 nt, Human
aucucaggguuuaaaacugugaggaaggagaaguaugaaggaagguagaaaaugcugguggg

SEQ ID NO: 1237 - RNA, 62 nt, Human
aucucauggaaacuggccagggguccuguuaacgucaucucaggguccagacccugaagauu

SEQ ID NO: 1238 - RNA, 62 nt, Human
aucucauucaugauguugauuuuuuuucaauguggugcaauauauacaauaaaauuugucau

SEQ ID NO: 1239 - RNA, 62 nt, Human
aucucucauccuuuuggauaaguuucuauucugucaguguuaaagauuuuguuuuguuggac

SEQ ID NO: 1240 - RNA, 62 nt, Human
aucucucccccacucccuugccccauaaccaaacauaagcuagcuagucuugucuaauagau

SEQ ID NO: 1241 - RNA, 61 nt, Human
aucucucuucucuaugccuaccuccccccauacccugcugaucucccugagccugccuuug

SEQ ID NO: 1242 - RNA, 63 nt, Human
aucucuuuucuugaccuaguauaaugacaacugcagugacuuaaguuuuugcuguuuucguuu

SEQ ID NO: 1243 - RNA, 63 nt, Human
aucugaauuauauauuugaaaaaugcacuugaaauacacuggauaauuacuuuugugauuuag

SEQ ID NO: 1244 - RNA, 62 nt, Human
aucugauuugggguuaaacuaggcggcuggaggauguuuacagcuuugaggcuucaaauaag

SEQ ID NO: 1245 - RNA, 62 nt, Human
aucugcaaauguggaugaggcuaauaguauguaccuaccucacugggaaacaccaaggcuua

SEQ ID NO: 1246 - RNA, 64 nt, Human
aucugccagaaccaccuggcccucuguagggcguuuaacuggaaauacccucacugccaagugg

SEQ ID NO: 1247 - RNA, 63 nt, Human
aucugccccacaccuucgaauccaugguagaacucacacuggagagaaacccuaugaguguaa

SEQ ID NO: 1248 - RNA, 63 nt, Human
aucuggaaaguaacaaccaugcuaagauggcaaacacacuggaaacaauugggccacuuggcu

SEQ ID NO: 1249 - RNA, 63 nt, Human
aucugggggccaaaggucaguggcaggggguauuucaguauuauacaacugcugugaccagac

SEQ ID NO: 1250 - RNA, 62 nt, Human
aucuggugacuuugacacugaagcggaagagccaaugaaggacugcaguauuugugugcccg

SEQ ID NO: 1251 - RNA, 63 nt, Human
aucugucaaaaaucuucgauuucauaaaaggacacacacuggagagaaacccugugaauguaa

SEQ ID NO: 1252 - RNA, 63 nt, Human
aucugucaagaaccuuucaauuuaugaaaggacacacacuggagagaaacccuaugaauguaa

SEQ ID NO: 1253 - RNA, 61 nt, Human
aucuguccccauccgaagaggcuuugugaacugccugcugaauggaaggaaagcaacuuua

SEQ ID NO: 1254 - RNA, 62 nt, Human
aucuguccucuguaguauuuuuuaaauaaaucaguguuuacauuagagcagucaggggucag

SEQ ID NO: 1255 - RNA, 62 nt, Human
aucuuaaaacacugaccucuaugagguauuuacugugcaauaacugauucauuuuuuucaga

SEQ ID NO: 1256 - RNA, 62 nt, Human
aucuuccaauacagaaucugucuauuuaugcuuguguuuacaaacuguauuuguuggguuug

SEQ ID NO: 1257 - RNA, 64 nt, Human
aucuuccauuucugcucucaaacccuacugggaucaaacuggaauaaauugaagacagccaggg

SEQ ID NO: 1258 - RNA, 64 nt, Human
aucuucucccagcagguccauagcaguaggcuuaggaugcaguauauggggccgcauuuaaaag

SEQ ID NO: 1259 - RNA, 63 nt, Human
aucuucuguagguuuucaagcacaugaaagaacucacacuggagaaaaacccuaugaauguaa

SEQ ID NO: 1260 - RNA, 62 nt, Human
aucuugagcaaguauuggucaugauacaguaauuuguuuacagaauccaaaaauacaauaga

SEQ ID NO: 1261 - RNA, 62 nt, Human
aucuuuaauucuugucauccaggucaacauaugaugcugcuauaagucuggggcucaaauug

SEQ ID NO: 1262 - RNA, 63 nt, Human
aucuuuacaacuguuuaaucaguuuuauuuuuguacaguauuagugaccuaaguuauuuugcu

SEQ ID NO: 1263 - RNA, 62 nt, Human
aucuuuauagaauaugcacaaguuuuucuacacucaguguuaaaguauuuauuaaugggaag

SEQ ID NO: 1264 - RNA, 62 nt, Human
aucuuucaaauggggauggugaucccugcccuuucuaccucauagggaugugagaaccaccu

SEQ ID NO: 1265 - RNA, 62 nt, Human
aucuuucacuaucuguaaugccuuuucucaccugucaucucacauuuucccuucccugaaga

SEQ ID NO: 1266 - RNA, 61 nt, Human
aucuuucucuagacuuccauggucugaauguugccugcugaaguagcaaccuaaaaaguau

SEQ ID NO: 1267 - RNA, 62 nt, Human
aucuuugaaaggcauugugggucugucuuuaaaguguuuacaaaaaaaaauuauauaaaaaa

SEQ ID NO: 1268 - RNA, 62 nt, Human
aucuuuguugagagauuugagguagcuccuguugcaguauuaauuuauaauauuuuaaaagu

SEQ ID NO: 1269 - RNA, 62 nt, Human
aucuuuuaggccuucauuuaucuucuaaaauuccucaucucaaggccaccaguccccaguua

SEQ ID NO: 1270 - RNA, 62 nt, Human
augaaaaaaacugcaucccaucacccaaaguucugugcaauagaaauuucuacagauacagg

SEQ ID NO: 1271 - RNA, 62 nt, Human
augaaaaagagacuguguaccuugaauucuacagcuaccucaguccaggcugccugcugaga

SEQ ID NO: 1272 - RNA, 62 nt, Human
augaaaaucauagcuggcuucuuuacagaaauugauaagcuagucccaaaauucauaaagaa

SEQ ID NO: 1273 - RNA, 62 nt, Human
augaaagcuaguagauguaaacauggaaaaauuguguuuacaauuuuauaaucucaguugau

SEQ ID NO: 1274 - RNA, 62 nt, Human
augaaaguuaaagaauguacugugaugaaauguucaguauuauguugcuucucaguaucaug

SEQ ID NO: 1275 - RNA, 62 nt, Human
augaaauaaguuuugaccuagacacaagggguauaugaaggaggaaaaaaauuucuuugcaa

SEQ ID NO: 1276 - RNA, 62 nt, Human
augaaauaauagggcauuuaacaaagaucgcuaugugcaauacuguauuuaguguuucuauu

SEQ ID NO: 1277 - RNA, 63 nt, Human
augaaaugacugugaagaauauaaaauuaaacuuagugacuuaauuagucacugccuugcuaa

SEQ ID NO: 1278 - RNA, 62 nt, Human
augaaauuccuguuucauggggcuguuuuucuuuucaucucacugggcagcagguuuaguga

SEQ ID NO: 1279 - RNA, 61 nt, Human
augaacaguuacaugauuuauaauuucacugauugagauuacuuuguaaguagcuguucag

SEQ ID NO: 1280 - RNA, 62 nt, Human
augaaguagguuccaguacuaaugaagugggcuccaguauuaaugaaauagguuccagugau

SEQ ID NO: 1281 - RNA, 62 nt, Human
augaagugagacccuuggggagaacgggcuguggaugaaggaguggacugcagccuuggccu

SEQ ID NO: 1282 - RNA, 62 nt, Human
augaaguuuagaugugcuguaauuuauaaauaaaaugaaggagguuaccuggcaauauguga

SEQ ID NO: 1283 - RNA, 61 nt, Human
augaauaagagauacaaggucucaccuucaucuacugugaagugaugagaacaggacuuga

SEQ ID NO: 1284 - RNA, 63 nt, Human
augaauaucgagcagaaguugaucaacucagggaaacacuggaaaaaauucaagucccaaacu

SEQ ID NO: 1285 - RNA, 61 nt, Human
augaauauuguacaguuaauuuccucacugaggacugugaacauucuuauauuauuucaug

SEQ ID NO: 1286 - RNA, 64 nt, Human
augacaaaaguuuuguguauucauuaaaagaaaacuaacuggaaaacagguuagauuaauucag

SEQ ID NO: 1287 - RNA, 62 nt, Human
augaccagaagacccugauggaaguggaggagaaucaucucaggcaaacuuuuugugugcca

SEQ ID NO: 1288 - RNA, 64 nt, Human
augacccccuuuguuccaagcaugcaguaucauaagaacuggaaaaacucaaauccgccaaaaa

SEQ ID NO: 1289 - RNA, 61 nt, Human
augaccugauaaagguuuucaugccucugggauugagauuagaggaagaaagcaaagaaag

SEQ ID NO: 1290 - RNA, 64 nt, Human
augaccuuggagugcagagaggagaacugaaaauaaaacuggaaagauguuccaacugcaagga

SEQ ID NO: 1291 - RNA, 63 nt, Human
augacucaaaggagacuucaagaacaguguaugaaacacuggaagaggucaccuaggaaaagc

SEQ ID NO: 1292 - RNA, 62 nt, Human
augagagugaaagggacaaauaacaucuguguagcaguauuaugaaaauagcuugaccucgu

SEQ ID NO: 1293 - RNA, 63 nt, Human
augagcaguuaagauauaaacaauuuaugcaugcugugacuuagucuauggauuuauuccaaa

SEQ ID NO: 1294 - RNA, 62 nt, Human
augagcccagguaagaccucucugaagagcugucaugaaggagggagggagcacauuccugg

SEQ ID NO: 1295 - RNA, 61 nt, Human
augagcuaaguuguuauuucuuucauucauaucccugcugaaauauugguacuagcaacuu

SEQ ID NO: 1296 - RNA, 62 nt, Human
augagggaagcaauagguagcuggggagcccuauugcugcuaagucauuggcaaagugacaa

SEQ ID NO: 1297 - RNA, 64 nt, Human
augaguacugacacuuagagcuguuuaaaggccgagaacuggaaacagccuuuccuccauuuuc

SEQ ID NO: 1298 - RNA, 64 nt, Human
augagugacaaguugggaaugauguggugauuuagaaugcaguauuggccaaguccaaguuguc

SEQ ID NO: 1299 - RNA, 64 nt, Human
augauaaggaaaagagucuauguauuuucaguauagaugcaguaauugugagccuaucaacaua

SEQ ID NO: 1300 - RNA, 64 nt, Human
augauaaguucauguccuuuguagggacaugaaugaaacuggaaaccaucauucucagcaaacu

SEQ ID NO: 1301 - RNA, 62 nt, Human
augauauguuauugugauaugguaucagcaacagucaucucagaaggugcagcaucuuggaa

SEQ ID NO: 1302 - RNA, 63 nt, Human
augauauuaagaucaaagggaggaagggaagacagcaguauuaauucacccuagauuacucaa

SEQ ID NO: 1303 - RNA, 62 nt, Human
augauccucauauggcccagugucaaguugugcuuguuuacagcacuacucugugccagcca

SEQ ID NO: 1304 - RNA, 64 nt, Human
augaucucaguggaauguuucauauuacccgaaaaaaacuggaaaucauccuuuguugugaaca

SEQ ID NO: 1305 - RNA, 62 nt, Human
augaugaccuuggcacugguuuggguggcaggauaugaaggaagcuguaggcauuauugaaa

SEQ ID NO: 1306 - RNA, 64 nt, Human
augaugagcagggcacuaucauacacacuggcugagaacuggaacuguuuuugggaagguggca

SEQ ID NO: 1307 - RNA, 62 nt, Human
augaugauucuguggagguauugccuugugaauuugcugcuauuuuaguuuugucuuugcug

SEQ ID NO: 1308 - RNA, 62 nt, Human
augaugauuucuuuucccugcacacaucuuuccggugcaauaucuaucaauugugaaucugg

SEQ ID NO: 1309 - RNA, 61 nt, Human
augaugcucccugcccaggccauauccuuuauuccugcugagcuuccuggcugaauagaug

SEQ ID NO: 1310 - RNA, 62 nt, Human
augaugcugcugcucccagaagguuugcuggauguguuuacauaggacucuaacuugugugc

SEQ ID NO: 1311 - RNA, 64 nt, Human
augauuaacaugcauuuucaauaugaggcaguguuuaugcaguauuuaacagagcaaucugcug

SEQ ID NO: 1312 - RNA, 64 nt, Human
augauuauugauugugagauagguuagguuuuggggggccaguaguucagugagaauguuuaug

SEQ ID NO: 1313 - RNA, 62 nt, Human
augauuuucucuuuucaacuucuugaacuuggacaugaaggaugugggcccagaaucaugug

SEQ ID NO: 1314 - RNA, 64 nt, Human
augcaaucuuuuuuuuuuuuaagcuaaaggugggugaacuggaaugaaaaucuuucugauguug

SEQ ID NO: 1315 - RNA, 63 nt, Human
augcacacagacauuuaucucugcacucacauuuugugacuuaugaagauaaauaaagucaag

SEQ ID NO: 1316 - RNA, 63 nt, Human
augcagauggcaagugcaccaaggagaaggcaggaacacuggagccugcaauaagggaggaga

SEQ ID NO: 1317 - RNA, 61 nt, Human
augcagcaucaucuuuugcagcauuccucugcuccugcugaucugugccacugaacuccag

SEQ ID NO: 1318 - RNA, 62 nt, Human
augcaggaagaggcccacuagagggcccaucaggcaguguuaccuguuagcucccugugggg

SEQ ID NO: 1319 - RNA, 62 nt, Human
augcauucacaccuuugcagcaugguuuaugccucaguguuaugugcacuggaauguuuucc

SEQ ID NO: 1320 - RNA, 62 nt, Human
augccaccucccucucucugaggcaggccuguggaugaaggaggagggucagggcuggccuu

SEQ ID NO: 1321 - RNA, 62 nt, Human
augccacuugaagauuucucugagaucaugaguuuguuuacacuugucucaagccuaucuau

SEQ ID NO: 1322 - RNA, 62 nt, Human
augccccuccaguucugguucaccuguaccuucuaugaaggagaauucgucaugucauucaa

SEQ ID NO: 1323 - RNA, 62 nt, Human
augccucaguuuccccauaauacccuuuuccaaccuaccucacaagguuaucagaaagauca

SEQ ID NO: 1324 - RNA, 64 nt, Human
augcggacaaaagccuccaaacuuuccaacuguguaggccaguacagcuggcaagguucauaga

SEQ ID NO: 1325 - RNA, 64 nt, Human
augcggcuaccaagaaacacaacaaugauuccauuaaacuggaaguuaagauugcuaccuggac

SEQ ID NO: 1326 - RNA, 63 nt, Human
augcguguuugggucagucugugcccucucaguagacacuggagcugcucugucccugaagag

SEQ ID NO: 1327 - RNA, 61 nt, Human
augcuacacuauucuuccuguugugauuguuuuacugugaacauaacaagguuguauuggg

SEQ ID NO: 1328 - RNA, 61 nt, Human
augcuacgcuccagcugauccagauguuaugcuccugcugauccagaugcccagaggcucc

SEQ ID NO: 1329 - RNA, 62 nt, Human
augcuaggggccaggccuccucugugacucugggcuaccucaguuuccccauuuuggccaga

SEQ ID NO: 1330 - RNA, 63 nt, Human
augcuauaccugcuaagauucaagcuguuuuccucacacuggacuuuaggccaaacccaguac

SEQ ID NO: 1331 - RNA, 62 nt, Human
augcucauugcacuauauuauaugcaaauuguuuugcugcuagguuuucaaaauuugaauaa

SEQ ID NO: 1332 - RNA, 62 nt, Human
augcuccaauaugucauccccggguguaucccaugugcaauaugaguauauagugguggcau

SEQ ID NO: 1333 - RNA, 61 nt, Human
augcuccguuucucugggaauuggugauuuuuuacugugaagaugaaauuacccuaauagc

SEQ ID NO: 1334 - RNA, 62 nt, Human
augcugccucuccucucuguguugucugggcccuuguuuacaagcacgcguuacccuuccug

SEQ ID NO: 1335 - RNA, 62 nt, Human
augcugcuuuggguuccauaauccuagggggcuauguuuacauaguaaaauacauccuacca

SEQ ID NO: 1336 - RNA, 63 nt, Human
augcuguacuuguagcuucucucuguuccucuguacaguauuaauagacaauaaacugccuuu

SEQ ID NO: 1337 - RNA, 63 nt, Human
augcuguagcuuaaaacauguuuugauaaguaauuacacuggaccuaggcaaaaccacugaag

SEQ ID NO: 1338 - RNA, 62 nt, Human
augcuguggggugcugguggagcagcugaugucguguuuacagagcaaggcuucccugucuc

SEQ ID NO: 1339 - RNA, 62 nt, Human
augcuguugcuaaagguggcgcagaaacaaauaucaguguuagucauugauaaugucugaag

SEQ ID NO: 1340 - RNA, 62 nt, Human
augcuuauuuuaaagguacuauuaaauaugugaauguuuacacuaauuuuaccgagugggac

SEQ ID NO: 1341 - RNA, 62 nt, Human
augcuugacaagacagaauuuuuuuggaagaaccucaucucacuauaguuacuuuuuucacu

SEQ ID NO: 1342 - RNA, 62 nt, Human
auggaaauguggaaaauaucguagguaaaggaaacuaccucaugcucugaagguuuuguaga

SEQ ID NO: 1343 - RNA, 62 nt, Human
auggaagcaggucugaggucagaagaaguagagaaugaaggaaaaggugaaugcuaugaaau

SEQ ID NO: 1344 - RNA, 62 nt, Human
auggaaggaauacuucuauuaaccaaauagaaucuguuuacaaaaaugguucguguguguua

SEQ ID NO: 1345 - RNA, 62 nt, Human
auggaagucauaaauggacauuauagucucuaaacaguauuaaacccuuaaccacuucuaaa

SEQ ID NO: 1346 - RNA, 62 nt, Human
auggaaugucuucagucauggaagagccuccauuucaucucauguccauuucuagccucuuu

SEQ ID NO: 1347 - RNA, 62 nt, Human
auggacauaaagucaaagaaugauggcagguaggaugaaggagagauacuuaggaaauccua

SEQ ID NO: 1348 - RNA, 62 nt, Human
auggaccaugauccuaagaugaguuuuaauuuuguguuuacagucaucucuuguacaacgug

SEQ ID NO: 1349 - RNA, 61 nt, Human
auggaggccagagcucauuuggguaaacuuacuccugcugaguuagcagguuggugagaga

SEQ ID NO: 1350 - RNA, 62 nt, Human
auggagggauauccccuuggauuucacuugcauugugcaauaagcaaagaaggguugauaaa

SEQ ID NO: 1351 - RNA, 62 nt, Human
auggaguuaaaaagagcuuuuguugagauuuggcaugaaggauauggugcucuauuuguaau

SEQ ID NO: 1352 - RNA, 61 nt, Human
auggaugauucagaaauuggaacagaauguuuuacugugaaacuggcacugaauuaaucau

SEQ ID NO: 1353 - RNA, 61 nt, Human
auggauggcagcaaaugaaaguaaagguucucaacugugaaugaaauuuagaaagauaauu

SEQ ID NO: 1354 - RNA, 63 nt, Human
auggauggugagcaucaugggaaagcuguaguuuagugacuuagcccuuagugauuaauagau

SEQ ID NO: 1355 - RNA, 62 nt, Human
auggcaaaacuaugcuuuugccaccuuccuguugcaguauuacuuugcuuuuaucuuuucuu

SEQ ID NO: 1356 - RNA, 62 nt, Human
auggcaaaaugaauccuucaugucuucuuguuauuguuuacacacuugcaguguagcccagu

SEQ ID NO: 1357 - RNA, 62 nt, Human
auggcaguuagugaauguaagaaguacaguguuaaaguguuguaaacaguuacucagugcaa

SEQ ID NO: 1358 - RNA, 64 nt, Human
auggcauccaagaugcuuuuacugaggaacauugacaacuggaaaacaaaucaagcuuggauuc

SEQ ID NO: 1359 - RNA, 64 nt, Human
auggcuaucauuagccacagguacugcugauuauaaggccaguaaaauuuuaguaccuggaggu

SEQ ID NO: 1360 - RNA, 62 nt, Human
augggacaaagcauuauggucuuuuuggguaagacaguauuagcaggauuuguaaaggguuu

SEQ ID NO: 1361 - RNA, 61 nt, Human
augggacagagacuuugcaauccgaaagaauagacugugaaaugaguucuuaaagaaaaga

SEQ ID NO: 1362 - RNA, 55 nt, Human
augggagacauccauuuaaggaucaacuguuuacaugugauacaucgaaaacugu

SEQ ID NO: 1363 - RNA, 62 nt, Human
augggaggcacaguaaagcugaugggauucugucucaucucauaccuuacauauaagucuca

SEQ ID NO: 1364 - RNA, 62 nt, Human
augggagugcaaaaaaaacaaagccaaaaaauauaugaaggauagcuguucuucuguguucu

SEQ ID NO: 1365 - RNA, 62 nt, Human
augggggcgccccucuugcccuguuccguuccccucaucucaagggaagaggcccuccagga

SEQ ID NO: 1366 - RNA, 62 nt, Human
augggggucuugacaaagcagaguaaaaauaugcuguuuacauuguuuacuuacaaguaagg

SEQ ID NO: 1367 - RNA, 62 nt, Human
augggugguugggagagaaacuagaacagaagaugugcaauagggcucagagcagccccagg

SEQ ID NO: 1368 - RNA, 62 nt, Human
augguaacuuggguaccgggggaacuuuaaaauuucaucucaaaaauaauuuuuaaaaagcc

SEQ ID NO: 1369 - RNA, 62 nt, Human
augguaguaggucauauaggggcaucugagccccugcugcuaagugagaucacauuauuuau

SEQ ID NO: 1370 - RNA, 62 nt, Human
auggucaaaggugcaggguuaauuucacaguacuugcugcuaaauuguuucucccaaggacu

SEQ ID NO: 1371 - RNA, 63 nt, Human
auggucuagaaaagucccuuauuauuuuauuuauuacacuggagcaguuacuucccaaagauu

SEQ ID NO: 1372 - RNA, 62 nt, Human
auggugagaucgcagaugcgcuauuaucuagauucaguguuacauuuucgauguuuaucacu

SEQ ID NO: 1373 - RNA, 61 nt, Human
auggugauuucugccaggggcugguagacaagaacugugaaagagagagagaaaaaaccuc

SEQ ID NO: 1374 - RNA, 64 nt, Human
augguggaaaaaauauaauuauuuucaucagacuuaaacuggaaauugaugauuucugaacuga

SEQ ID NO: 1375 - RNA, 62 nt, Human
augguggacuacuagucacugcuuccauaaauauuguuuacagggugagauuugguuuauuc

SEQ ID NO: 1376 - RNA, 64 nt, Human
augguguauuuugaacccauucugauagucucuuuuaacuggaagauuucaauuacuuacguua

SEQ ID NO: 1377 - RNA, 62 nt, Human
augguuaaccuuuggagagagagaggagaccaggaugaaggagccagucgaagauccuguuc

SEQ ID NO: 1378 - RNA, 63 nt, Human
auguaaaagugagguagugaacauccuaaauuucuacacuggaauuacuaaauaaucuuauuu

SEQ ID NO: 1379 - RNA, 63 nt, Human
auguaaauuauaaguaacuugucaaggaauguuaucaguauuaagcuaaugguccuguuaugu

SEQ ID NO: 1380 - RNA, 62 nt, Human
auguaacuauuuugaaugcccacaaaucccauuccaguguuacuuucugugaaugcaguacc

SEQ ID NO: 1381 - RNA, 63 nt, Human
auguaaggaaccgaugggccauuaaacaugaacugaacgguuaaaagcacagucuauggaacg

SEQ ID NO: 1382 - RNA, 62 nt, Human
auguaaucguaaauauuaauuuuguaccuauauugugcaauacuugaaaaaaacgguauaaa

SEQ ID NO: 1383 - RNA, 62 nt, Human
auguaauguaguucuuuguuccugcuuucucuuucaguauuaaacucuccuuugauauuaug

SEQ ID NO: 1384 - RNA, 62 nt, Human
auguacaaagaacuaugcugucuuauuuauguuuuguuuacauaauguauaguuuuuuaagu

SEQ ID NO: 1385 - RNA, 62 nt, Human
auguacaucuaccccagccccucaaaagaaaaacuguuuacauagaaauuccuacacauacg

SEQ ID NO: 1386 - RNA, 62 nt, Human
auguaguaucaaaggaggcucuagguuuugucuaucaucucaguucagaggcaacgaaacug

SEQ ID NO: 1387 - RNA, 62 nt, Human
auguauacaucauaguucaaaacccaguagucauuguuuacagcaaauaaagaaauauuuag

SEQ ID NO: 1388 - RNA, 62 nt, Human
auguauacaucugaaugaaaagcaaagcuaaauauguuuacagaccaaagugugauuucaca

SEQ ID NO: 1389 - RNA, 61 nt, Human
auguauguaauguaaugagagcacuuuucauugacugugaacuuuuuauuuuugaaucugc

SEQ ID NO: 1390 - RNA, 63 nt, Human
auguauuucugaaucaguccgcuaauaugauugugcaguauuagcuugcuuuugcugcugugu

SEQ ID NO: 1391 - RNA, 62 nt, Human
augucacuugguuuauuccugcaagucagaugcaucaucucacucacagggggugcauuuua

SEQ ID NO: 1392 - RNA, 62 nt, Human
augucauucagaaaccugaaguguggcugcaucuugcugcuaaugugugauguugacgccua

SEQ ID NO: 1393 - RNA, 64 nt, Human
auguccugguuuccugccuccauuucucugggaccgaugcaguaucagcagcucuuuuccagau

SEQ ID NO: 1394 - RNA, 63 nt, Human
augucuaacacauaagccaggacauucugcugugagugacuuauuguacccaacucuauuucu

SEQ ID NO: 1395 - RNA, 64 nt, Human
augucucaaucugaauuuauuuggcuacacuaaagaaugcaguauauuuaguuuuccauuugca

SEQ ID NO: 1396 - RNA, 61 nt, Human
augucuuaaugcuguccuaccauuauuuuaccaacugugaaagcuggcuuuaauuuuuagg

SEQ ID NO: 1397 - RNA, 62 nt, Human
augucuuuagccaagaauuuuauucacuuaaauuuguuuacaacuuguauaaagcaaaaaag

SEQ ID NO: 1398 - RNA, 62 nt, Human
augucuuuuaugcuauaaucauuccaaauuuugccaguguuaaguuacaaauguggugucau

SEQ ID NO: 1399 - RNA, 62 nt, Human
augucuuuuguaaaacaaaaauuacaaaaaaauuuguuuacauuccacugguaccuuaauuu

SEQ ID NO: 1400 - RNA, 63 nt, Human
augugaacagccauccugaacugccaucagcuaccacacuggacucugcagggcagccauccu

SEQ ID NO: 1401 - RNA, 64 nt, Human
augugacugaaacaaaauguuuuuugauaggaaggaaacuggaauucuuuguacuaauacaggg

SEQ ID NO: 1402 - RNA, 64 nt, Human
augugacugaucaccucuccguuuaucuguuugaucaacuggaauuucuauacagaagguuuau

SEQ ID NO: 1403 - RNA, 62 nt, Human
augugauacuuccacugaccggcugcagcucugcaugaaggacucggggucuggaugccaug

SEQ ID NO: 1404 - RNA, 63 nt, Human
augugauaucaaugaagaaauauuuguagcauguaaacgguuauuucuguuucuuaaaaagua

SEQ ID NO: 1405 - RNA, 62 nt, Human
augugaugcucagauaaguacauuuauaucaguucaguguuaaaaugcagucucuugaguua

SEQ ID NO: 1406 - RNA, 62 nt, Human
auguggcuuuacuaacuucccagggggcagcuaagugcaauacuauauguuaggaaaacgga

SEQ ID NO: 1407 - RNA, 63 nt, Human
auguguauuuauacccccaggaaacuagcuuuugccaguauuaugcauauauaaguuuacacc

SEQ ID NO: 1408 - RNA, 62 nt, Human
auguguccauaauuuaaaauucauguuauaguuucaguauuaaggcugacuuuuuuuuuuua

SEQ ID NO: 1409 - RNA, 64 nt, Human
auguguuccuguugggcguuacuagaaacuauggaaaacuggaaaauaacuuugaaaaaauugg

SEQ ID NO: 1410 - RNA, 62 nt, Human
auguguucuugcauuuugguugaaauaaccuacacaguguuaaaaaucagauaccuccuuua

SEQ ID NO: 1411 - RNA, 63 nt, Human
auguguuuaaacaaauguaauauuuuguacaagauacacuggagaacaaagggaacucaagau

SEQ ID NO: 1412 - RNA, 61 nt, Human
auguuaagaguauaguuagauaugugaaguguaugagauuaugacaaggauacacucaugu

SEQ ID NO: 1413 - RNA, 64 nt, Human
auguuauauugguggcaucagucaacaguguaugucaugcaguacagacauagcaagccuuguc

SEQ ID NO: 1414 - RNA, 64 nt, Human
auguucagagggagccagcucuuuauguuggccccaggccaguacuaagcaaauuaaaaagacc

SEQ ID NO: 1415 - RNA, 62 nt, Human
auguucgucucucucucucucucucucuagcuucucaucucauuguuaggaucuaauguucu

SEQ ID NO: 1416 - RNA, 64 nt, Human
auguugguguucuaaccgauuucuaaugcuaauuucaacuggaagcacuuuuucaagcccagcu

SEQ ID NO: 1417 - RNA, 63 nt, Human
auguuuaaaaacuucaucgacuuagccugagucauaacgguuaagaaagcacuuaaacagaag

SEQ ID NO: 1418 - RNA, 62 nt, Human
auguuuaaugcauauuuaacuuauuuaauguauuucaucucauguuuucuuauugucacaag

SEQ ID NO: 1419 - RNA, 64 nt, Human
auguuuauuacaaaauuuuaaagaagaauauguaacaugcaguacugauauuauaauucucauu

SEQ ID NO: 1420 - RNA, 62 nt, Human
auguuucagggcucaacuuuuuaaaauccagacccaguguuaaaaccauuuauuccuuuuuu

SEQ ID NO: 1421 - RNA, 62 nt, Human
auguuucucuuugauuauuugcauguuauguuuaauaagcuacuagcaaaauaaaacauagc

SEQ ID NO: 1422 - RNA, 62 nt, Human
auguuucuguuugggcaccacugaggaaggaagcaugaaggacgcacaggucaggccauucu

SEQ ID NO: 1423 - RNA, 63 nt, Human
auguuucuguuuuggugucucacuuuccucccagcgugacuuauuuggggauuccucagggcc

SEQ ID NO: 1424 - RNA, 62 nt, Human
auguuuuaaaauauaaaacaaagccaaguuaaacuguuuacacugaugugcuauaaaagcac

SEQ ID NO: 1425 - RNA, 61 nt, Human
auguuuuucauuuugcugcaaaucuauaucugaccugcugaggaaaucguuuggugaaaug

SEQ ID NO: 1426 - RNA, 64 nt, Human
auguuuuuucuauaagacacugcuuaaaagaguccaaugcaguaugaauuuguauuuguguuua

SEQ ID NO: 1427 - RNA, 62 nt, Human
auuaaaaguagcacauuacaugguuagaaaaugucaguguuaaagaaugguacaaagugaaa

SEQ ID NO: 1428 - RNA, 62 nt, Human
auuaaacauucugcauuggguauaaucuaagaauuguuuacaaaaagauuauuuuguauuua

SEQ ID NO: 1429 - RNA, 62 nt, Human
auuaaauaauaguacugcagcuucuuguggccuacaguguuauguuugcuguaagaauaaga

SEQ ID NO: 1430 - RNA, 61 nt, Human
auuaaauuauuuaauauuugacugauuucaauaacugugaaaaauaaaaaagguguuguau

SEQ ID NO: 1431 - RNA, 62 nt, Human
auuaacaauucccccagaacauggaaauaaccauuguuuacagagcugagcauuggugacag

SEQ ID NO: 1432 - RNA, 61 nt, Human
auuaacgccacauuuuuuaaauagacaaaaauaugagauuaaaaauguugaauuuuacuaa

SEQ ID NO: 1433 - RNA, 61 nt, Human
auuaagagcaaacuuuagugucucuaaguuaugacugugaaaugauugguaggaaauagaa

SEQ ID NO: 1434 - RNA, 62 nt, Human
auuaaggcaguacaaauuguggagccuuuuaacugugcaauaauuucuguauuuauuggguu

SEQ ID NO: 1435 - RNA, 62 nt, Human
auuaagucauuggauuuuacucuguucuguuuacaguuuacuauuuaagguuuuauaaaugu

SEQ ID NO: 1436 - RNA, 61 nt, Human
auuaauacgguacagguaaaaaggaccccaacaacacuggagauggggagucccaggaagc

SEQ ID NO: 1437 - RNA, 63 nt, Human
auuaauagugaggaagccuauuugaacuacuuaaacaguauuaaagcccuuuuuaaaaagcac

SEQ ID NO: 1438 - RNA, 61 nt, Human
auuaaucaauuucucaauaguucuuaaaauuagugagauuaaaaaucuaaaaauuuugcau

SEQ ID NO: 1439 - RNA, 62 nt, Human
auuacacauuuuauauaugagccauuuagauaugcaguguuaauucuauacugcauuugaag

SEQ ID NO: 1440 - RNA, 62 nt, Human
auuacacuaaaaguauuauaguaacguauuguccuuccguuaacagaaacaucacaauucaa

SEQ ID NO: 1441 - RNA, 62 nt, Human
auuacagccauugcaaaacauuggagaauccauaaugaaggaggucuuacaaguguaauaaa

SEQ ID NO: 1442 - RNA, 63 nt, Human
auuacauauguacaaauugaaacuguaaauugugaacacuggaaagcaccauugugacauaga

SEQ ID NO: 1443 - RNA, 61 nt, Human
auuaccacuccugauacagggcuuuauuguacuacugugaaguguaugugugcaauacauu

SEQ ID NO: 1444 - RNA, 62 nt, Human
auuaccuaaaauauuguuuaccaaaaagauucuguguuuacauguucuuuucuucuggugau

SEQ ID NO: 1445 - RNA, 62 nt, Human
auuacuccuguaccuucugcucaauuuccuuuccucaucucaaauaaaugccuuguuacuug

SEQ ID NO: 1446 - RNA, 62 nt, Human
auuacugcaauguucucuuaacaguuaaacaagcuguuuacaguuuaaacugcugaauauua

SEQ ID NO: 1447 - RNA, 61 nt, Human
auuacugcuugggauguguucuuuggcagcuugugagauuacuuuaccuaguguuuauaaa

SEQ ID NO: 1448 - RNA, 62 nt, Human
auuacuggguagauacccaaaggauuacaaaucaugcugcuauaaagacacaugcacacaua

SEQ ID NO: 1449 - RNA, 62 nt, Human
auuacuggguauauacccaaaggauuauaaaucaugcugcuauaaagacacaugcacacgua

SEQ ID NO: 1450 - RNA, 62 nt, Human
auuagagauccagcacauucucaguacuguggugcaguauuagcccaaaucuguguaauggg

SEQ ID NO: 1451 - RNA, 61 nt, Human
auuagagcuuauccgaacuggggaaagacggauugagauuaacugcugggaccuccuaccu

SEQ ID NO: 1452 - RNA, 62 nt, Human
auuagaguagauaaugggucaccuugauagccucuguuuacauuacuuguauaugggcaaaa

SEQ ID NO: 1453 - RNA, 61 nt, Human
auuagccaaacuugaauucuaguuuuaaaacugacugugaauuuuauuuuucauauauuua

SEQ ID NO: 1454 - RNA, 62 nt, Human
auuaggaaaauuaauuuguuaacucgucugugcacaguauuauuuacucugucuguaguucc

SEQ ID NO: 1455 - RNA, 62 nt, Human
auuaggaagccauaaaacaagauauuaugaaacccaguauuauaaauguuaucuacaucuaa

SEQ ID NO: 1456 - RNA, 63 nt, Human
auuaggggaaaucaaaucugguugguaggugucuacaguauuagaagaggguauaagggcacu

SEQ ID NO: 1457 - RNA, 63 nt, Human
auuagguguaaaaguguacaauauauuuuuauacugugacuuaauuugucauuaacaaacuuu

SEQ ID NO: 1458 - RNA, 64 nt, Human
auuauaaauuuuucuuuucacauuuuacuguguuuuaacuggaaauaaaauuauggcugcuaca

SEQ ID NO: 1459 - RNA, 61 nt, Human
auuauagugaauuacuguuuacaaaauacacauacugugaacagauauaaguuucugucuu

SEQ ID NO: 1460 - RNA, 62 nt, Human
auuauaucuuuaauauauaguaauguaacauauucaguauuaauguauaaaaagcacucuaa

SEQ ID NO: 1461 - RNA, 62 nt, Human
auuauauguuuauaaaguuauuaauuuguaaaggcaguguuacaaaauguucaguuuauauu

SEQ ID NO: 1462 - RNA, 64 nt, Human
auuaucauuuuguugauugugcuuuuauguaauaaaaugcaguacuuuaaaacauuuagaugug

SEQ ID NO: 1463 - RNA, 63 nt, Human
auuaucuuacugguucaacauuuuucugauauaugcaguauuacagauauucagcaaaaguau

SEQ ID NO: 1464 - RNA, 62 nt, Human
auuaucuugcagauaaagaaaaaaauuaagaguguguuuacaacuguuuucucuuuuuuaca

SEQ ID NO: 1465 - RNA, 62 nt, Human
auuaugacuaaucugcuuuaggaguugggguaaccaguauuacaggagggacuuucagagcc

SEQ ID NO: 1466 - RNA, 64 nt, Human
auuaugccccaguucagaaauuuggcauugaucuuaaacuggaacaugcuuuuacuuuauugcc

SEQ ID NO: 1467 - RNA, 62 nt, Human
auuaugguuuucuuauucgugaaaauucggagagugcugcuaaaauuggauuggugugaucu

SEQ ID NO: 1468 - RNA, 62 nt, Human
auuauuaccaugaguauaauuuuaagaaugaaaauguuuacaguauuuucaguuuuauuaua

SEQ ID NO: 1469 - RNA, 62 nt, Human
auuauuaccaugcacuggcaauuccaaacaaugucaguguuaaaaugcuucucccugaaaaa

SEQ ID NO: 1470 - RNA, 61 nt, Human
auuauucuauugagaaagcacuggaauguuuugugagauuauuuuuauaugaaggaauagc

SEQ ID NO: 1471 - RNA, 63 nt, Human
auuauuuucuguacuuuuuuguucauuaauuuugucaguauuacaccaaacuguuuuugcaac

SEQ ID NO: 1472 - RNA, 63 nt, Human
auuauuuuugaauggaaauacuacugagaccauugacacuggauaacaguaaugaucccauua

SEQ ID NO: 1473 - RNA, 63 nt, Human
auucaaaguauauacagagccuguuuuaaaaaauacaguauuauuuaguaaaauuaucuguuc

SEQ ID NO: 1474 - RNA, 64 nt, Human
auucaagaguauucucacuucuggguuaucagcauaaacuggaauguagugucagaggauacug

SEQ ID NO: 1475 - RNA, 63 nt, Human
auucacaauuugcuguaacccuuaacuuaaauagccaguauuaucuugcccuuuugaacauuu

SEQ ID NO: 1476 - RNA, 62 nt, Human
auucacaguugguguccugucacuuuguuuuaaaauaagcuagaaccaggaugcuuccuuau

SEQ ID NO: 1477 - RNA, 62 nt, Human
auucacuuagaaauuuuauuuucuuauaacuuaagugcaauaaaauguguuuuuucauguua

SEQ ID NO: 1478 - RNA, 63 nt, Human
auucagaaugauaaccucuuuuagagaacaaauaagugacuuauuuuuuuaaagcuagaugac

SEQ ID NO: 1479 - RNA, 64 nt, Human
auucaggaacuuuucauuguuuggggaagcuuuugaaugcaguacuguggaggaaaucauccuu

SEQ ID NO: 1480 - RNA, 61 nt, Human
auucagggaaauggcuuauuaaacuuugaagcaacugugaauucauucuggaggggcagug

SEQ ID NO: 1481 - RNA, 61 nt, Human
auucaugaauuaaauuacuaaaaguauguuuauacugugaauuaauauaauguauucacau

SEQ ID NO: 1482 - RNA, 62 nt, Human
auucauuuauuucuguuuuguuuaccgacauauucaguauuauucuuguuuucugaauucug

SEQ ID NO: 1483 - RNA, 62 nt, Human
auucauuugcuacagugcaggaaccaaaacuuguucaucucaugauucccuacaucugacau

SEQ ID NO: 1484 - RNA, 64 nt, Human
auuccaaggacucggauuggauguucagaauucagcaacuggaaaguccuuaaaaacaaacagg

SEQ ID NO: 1485 - RNA, 62 nt, Human
auucccuagucauuuccaaacuugaaaacagaaucaguguuaaauucauuuuauucuuauua

SEQ ID NO: 1486 - RNA, 62 nt, Human
auuccuagcacuaauaguuggcuuucuuuuuuuuuguuuacauagaagcaggguuuuuuuuu

SEQ ID NO: 1487 - RNA, 62 nt, Human
auuccucagcuucuucacaggcacuccuggagauaugaaggauuacucuccauaucccuucc

SEQ ID NO: 1488 - RNA, 63 nt, Human
auuccugaguucuuccucucaaaauuucugugcaccaguauuauuccucauuuuacauacagg

SEQ ID NO: 1489 - RNA, 62 nt, Human
auuccuuugugugauuucuuaaugcuguauuuguucaucucaaaccuagauguauacagcuc

SEQ ID NO: 1490 - RNA, 63 nt, Human
auucgaccuauaagaagccuuaauuugcacagugugugacuuacagaaacugcaugaaaaauc

SEQ ID NO: 1491 - RNA, 64 nt, Human
auucguaauaauuuagugauggaauuuuuuaauaacaugcaguauauaaaugugcagauuuuau

SEQ ID NO: 1492 - RNA, 63 nt, Human
auucuaaguguguucaggcuucugaagguaaagggacacuggauccagaagcuauggaaccag

SEQ ID NO: 1493 - RNA, 64 nt, Human
auucuauaauuggaagagaaaaaaagaaaaacuuuuaacuggaaauguuaguuuguacuuauug

SEQ ID NO: 1494 - RNA, 62 nt, Human
auucuaugaaaccccgaauuuagaaacaucuggucuaccucaguuaaauguugacugcuuag

SEQ ID NO: 1495 - RNA, 62 nt, Human
auucuaugccugcucuagaauugaaagacuucagcaguauuaaagcauuuuuuaaucuugga

SEQ ID NO: 1496 - RNA, 63 nt, Human
auucuauucgaggauuuuauaauggcauauuuuuucaguauuaaagcgaaaauguuuucaacu

SEQ ID NO: 1497 - RNA, 64 nt, Human
auucucaucauuuagcucccacuuauaagugaggacaugcaguauuugguuuucuguucccaug

SEQ ID NO: 1498 - RNA, 61 nt, Human
auucuccucagugcugagaguucuucaguccugccugcugacuucccuccaggacagaaca

SEQ ID NO: 1499 - RNA, 64 nt, Human
auucucuuuuaaugaggaccaauguacaguugaaauaacuggaacaaauuauuuuuggugugug

SEQ ID NO: 1500 - RNA, 61 nt, Human
auucugagggaaaaucugacaccuaagaaauuuacugugaaaaagcauuuuaaaaagaaaa

SEQ ID NO: 1501 - RNA, 62 nt, Human
auucuggauuuuguccuacaagucugugccauuuauaagcuaaguugaggguucagagggag

SEQ ID NO: 1502 - RNA, 62 nt, Human
auucuguuuuuuuuauuuuuauuuuuaaaugagggugcaauaucuaauguaagacuuaaauu

SEQ ID NO: 1503 - RNA, 63 nt, Human
auucuuaaggagcuuuaagcuaaggaaaccuuuuagugacuuagcuuauuuuguaucuuuuca

SEQ ID NO: 1504 - RNA, 62 nt, Human
auucuuaauucuguaaaagugaaauaaaauaacuuuccguuaauuauauauuuuugucaaaa

SEQ ID NO: 1505 - RNA, 62 nt, Human
auucuuacaaaucuuuuaagagggcuguaacaguugcugcuaguauuaggguuccacaucau

SEQ ID NO: 1506 - RNA, 62 nt, Human
auucuucuaaugauggucaacugcaaggagaaacuguuuacauccuucccacuacacaguug

SEQ ID NO: 1507 - RNA, 62 nt, Human
auucuugaaaacugcuguagcaaauucaucuguggugcaauacacuuuuugauuaaagcucu

SEQ ID NO: 1508 - RNA, 63 nt, Human
auucuugagcaaucgcucgguccguggacaauaaacaguauuaucaaagaggccuccaacgcc

SEQ ID NO: 1509 - RNA, 62 nt, Human
auucuugaguucuggaagggacuuuagagaauaccaguguuauuaaugacaaaggcacugag

SEQ ID NO: 1510 - RNA, 62 nt, Human
auucuuguugcauugucucugcagauucuauuuuuguuuacaauauuaaaauguauguuagc

SEQ ID NO: 1511 - RNA, 61 nt, Human
auucuuuaaucaugucuuucugaaauguguauuugagauuagaaauugagguugagaggaa

SEQ ID NO: 1512 - RNA, 61 nt, Human
auugaauaccuguuucuccauguguaucgucucugagauuaccuucuugcccuuuccaaca

SEQ ID NO: 1513 - RNA, 64 nt, Human
auugaauucaaggugacuagaaagaaacaggcagacaacuggaaagaacugacuggguuuugcu

SEQ ID NO: 1514 - RNA, 61 nt, Human
auugacauuauugaaggaaaggggaugaggacaacugugaacucacagugagcccugugga

SEQ ID NO: 1515 - RNA, 62 nt, Human
auugaccucuaaaauucuauucaguuguaugauuuguuuacauaguuccacaagaccuucau

SEQ ID NO: 1516 - RNA, 61 nt, Human
auugacuaggcuguaugacauuuugagcucuuaacugugaauggcauucauuaagcuccuu

SEQ ID NO: 1517 - RNA, 62 nt, Human
auugagggaccaucagauaacuguauuuugucaggugcaauaaaaacaaaauuaaaacccaa

SEQ ID NO: 1518 - RNA, 61 nt, Human
auugaggguugaaucuccuggugagauuauacaggagauucucuuucuucgcugaagugug

SEQ ID NO: 1519 - RNA, 64 nt, Human
auugaucauauuacauguacuaaggaaugagauuauaugcaguaaacccaacuggaagauuaac

SEQ ID NO: 1520 - RNA, 62 nt, Human
auugaugaucacugugaaaauugaccaagugauguguuuacauuuacugaaaugcgcucuuu

SEQ ID NO: 1521 - RNA, 61 nt, Human
auugaugggacaugaagacaucuuuggaaaugaugagauuauuuccuguguuaaaaaaaaa

SEQ ID NO: 1522 - RNA, 62 nt, Human
auugcaaaguaguuucccaaggcauuuccccuauuguuuacauggucaaaaggaaaaucaaa

SEQ ID NO: 1523 - RNA, 62 nt, Human
auugcaacauuuccaucagacagcauuucaauuccaguauuauguauauugcaaauuaaaca

SEQ ID NO: 1524 - RNA, 61 nt, Human
auugcaauagaauccugaaaauugacccugggaugagauuaauucaauagaaaaauugcug

SEQ ID NO: 1525 - RNA, 62 nt, Human
auugcacuccagccuggucaacaagaguaaaacuucaucucaaaaaacaaaacaaaacaaaa

SEQ ID NO: 1526 - RNA, 62 nt, Human
auugcacuccugccugggcaacaagagcaaaauuucaucucaaaaauaagauaaaauaaaau

SEQ ID NO: 1527 - RNA, 62 nt, Human
auugcauuuuacgcaaacuuugagccuuucucuugugcaauaauuuacauguuguguauguu

SEQ ID NO: 1528 - RNA, 62 nt, Human
auugccaaaaucaaauaaauggcuucucagcugcuguuuacaacaaacuucccuaaccaaaa

SEQ ID NO: 1529 - RNA, 61 nt, Human
auugccuuuggccuuccauucugacuucucugaugagauuauugucaacccugcuuucccu

SEQ ID NO: 1530 - RNA, 61 nt, Human
auugcugaaaaucaagcacauauuuugaaauggacugugaaggaaaaggggacaggaacaa

SEQ ID NO: 1531 - RNA, 63 nt, Human
auuggagagaugauaucaauguaaaggaugaucaaacacuggaauauauuuuccuaggacuuc

SEQ ID NO: 1532 - RNA, 61 nt, Human
auuggccccgccuaaggggaccccugcucccagccugcugagagcccccaccuugauccca

SEQ ID NO: 1533 - RNA, 64 nt, Human
auuggcuacuccaucuguccuagcagagugugacuaaacuggaaauguauggagcugcauuuuu

SEQ ID NO: 1534 - RNA, 61 nt, Human
auugggacauuguaacuuaucuauuuauaguuaugagauuaagacuggagugccaucaccg

SEQ ID NO: 1535 - RNA, 62 nt, Human
auuguaaggagccuucaauuuucuuuagcgacuacuaccucagcaacaggaggcagcaaggg

SEQ ID NO: 1536 - RNA, 64 nt, Human
auuguaugcuuuuucuuuuguucaaucucucaccacaacuggaaguguugccucaacuacacag

SEQ ID NO: 1537 - RNA, 61 nt, Human
auugucccguuaauagccccucagaagauguucccugcugauaacagcauccuauuuuacu

SEQ ID NO: 1538 - RNA, 62 nt, Human
auugucugaccacauucuuuuuguauccaaauagugcugcuagaaacugcacugaaguggcu

SEQ ID NO: 1539 - RNA, 62 nt, Human
auugucuggugguggggggcaggggacagaggccaugaaggagcaaguuuuguauuugugac

SEQ ID NO: 1540 - RNA, 61 nt, Human
auugucuuuguagaaaauucuaaauaacaaaaaccugcugacauuaauaagcaauuauagc

SEQ ID NO: 1541 - RNA, 62 nt, Human
auugugaaaauucugaguugaagguuaguuuaagauaagcuaacaauaacagucuguguuuu

SEQ ID NO: 1542 - RNA, 62 nt, Human
auugugagcaggguucaucuauuuuaaacacagauguuuacaaaauaaagauuauuucaaac

SEQ ID NO: 1543 - RNA, 62 nt, Human
auugugcuauuugagaugaaugguuaguauuuuguguuuacaugaaaauaaauguuuaaaaa

SEQ ID NO: 1544 - RNA, 64 nt, Human
auuguguguggugaaugaguucagugaguccccaugaugcaguaguuuuuuuaaaaaauuagag

SEQ ID NO: 1545 - RNA, 62 nt, Human
auuguuaaaaacugcauuaugcaaaaauuuuguacaguguuaaggccuaaaaacuguguggu

SEQ ID NO: 1546 - RNA, 62 nt, Human
auuguuacgggcuaaaucaagagcagcuuaauccuguuuacaaugugagcuuuuugugcguc

SEQ ID NO: 1547 - RNA, 61 nt, Human
auuguuauguaaauaggcuuuccuaugucaaacacugugaaugagaaaguauuugucucuc

SEQ ID NO: 1548 - RNA, 64 nt, Human
auuguuauuaaggaugcaugacaggaauguuggcagaacuggaaaguauuaaaaaagcauuauc

SEQ ID NO: 1549 - RNA, 64 nt, Human
auuguuuccaacuugucugggaauugugugucugguaacuggaaggccuuccacuguggcaaau

SEQ ID NO: 1550 - RNA, 62 nt, Human
auuguuucccuggggaagcagugggagagcagacucaucucagaacacagcacaggggguaa

SEQ ID NO: 1551 - RNA, 62 nt, Human
auuguuuuuuguugaaaaacugacuuucuguugucuaccucaggccuugugcauuuggguua

SEQ ID NO: 1552 - RNA, 62 nt, Human
auuuaaaaaaggaaaggagaaaaaucacgacuacuguuuacagacugaaaaauuauugcuuu

SEQ ID NO: 1553 - RNA, 62 nt, Human
auuuaaaaacaaaguguccaagcugucagugguguguuuacaaucucuccuggcagagguug

SEQ ID NO: 1554 - RNA, 62 nt, Human
auuuaaaauuucguuguccaauuuguaaguaacacaguauuaugccugaguuauaaauauuu

SEQ ID NO: 1555 - RNA, 62 nt, Human
auuuaaagccuuuagagccagcccauggcuuuagcuaccucacuaugcugcuucacaaaccu

SEQ ID NO: 1556 - RNA, 62 nt, Human
auuuaaaugaaucucacauuaaaagaaagcuugacaguguuaugaaagccaccagacucagc

SEQ ID NO: 1557 - RNA, 62 nt, Human
auuuaaccagcuuuuaaaucucucuuuucucuaacaguguuagaaguuugugauucuccaaa

SEQ ID NO: 1558 - RNA, 61 nt, Human
auuuaagggaaaacccccaaaggcuacaggcgaccugcugaucaggaaagaauuucgcucu

SEQ ID NO: 1559 - RNA, 62 nt, Human
auuuaaugugucagauauugugcuugaaagauucucaucucagaauacuuuuggacuugaaa

SEQ ID NO: 1560 - RNA, 63 nt, Human
auuuacaacuuacauuuacaauuuauaguguuuaccaguauuaaauucucagccacuccuuuc

SEQ ID NO: 1561 - RNA, 62 nt, Human
auuuacagucauuggaagauuuguguuuugcaaacaguguuaagugauauugcuagauggug

SEQ ID NO: 1562 - RNA, 62 nt, Human
auuuacuagaaaauaucaucuuagaagaaaccccaugaaggaaaagaauagggaaaagcuuu

SEQ ID NO: 1563 - RNA, 64 nt, Human
auuuacugaccgucugauguguaagauguggaauaaaacuggaaucaauuaauuauuucacugu

SEQ ID NO: 1564 - RNA, 62 nt, Human
auuuaguuaugacagugucacuguauccuaguuauguuuacagcacaaauaaauaaugacug

SEQ ID NO: 1565 - RNA, 62 nt, Human
auuuauccauucugcuguugauggacuuuuacauuguuuacagcuuagggucauaauaaauc

SEQ ID NO: 1566 - RNA, 62 nt, Human
auuuaucuauucccuuaauacauauuccuguuuccaguguuagauuaaugcaaauaaggcua

SEQ ID NO: 1567 - RNA, 62 nt, Human
auuuauucuauucuaauuauuugacagguaacugcaguguuaaauuguaaauguguuuucuu

SEQ ID NO: 1568 - RNA, 64 nt, Human
auuuauuguaaugaguuugcauuucagcuuuauucaaugcaguacaaaauaguuuucuuuaagc

SEQ ID NO: 1569 - RNA, 61 nt, Human
auuucaaggccauauuuuaaaaaaucaaaaggcacugugaacuauuuugaagaaaacacaa

SEQ ID NO: 1570 - RNA, 61 nt, Human
auuucaauaaauaguucacuucagguuugggauugagauuaguugcaauauauuuagaagc

SEQ ID NO: 1571 - RNA, 64 nt, Human
auuucacacuucaugugccuuacugaugagaguacuaacuggaaaaaggcugaagagagcaaau

SEQ ID NO: 1572 - RNA, 62 nt, Human
auuucacuuucugaucacgguacguccauaaagccaguauuacacuuaaaugaaguauucuu

SEQ ID NO: 1573 - RNA, 62 nt, Human
auuucagguggacuuugcaaggacugauggauagcuaccucagggaccagaauccgugggaa

SEQ ID NO: 1574 - RNA, 62 nt, Human
auuucaugccaguaaaauuuuuuuagugguauucuguuuacagauguauuaggaccauugau

SEQ ID NO: 1575 - RNA, 62 nt, Human
auuucauucaaaguuuuguaacacuuagcuagugauaagcuagaaggaaauuugcauuuuaa

SEQ ID NO: 1576 - RNA, 62 nt, Human
auuuccauauguuuuauauaaauauauauauaauaugaaggacuacccuccuuuuuuuuuuu

SEQ ID NO: 1577 - RNA, 61 nt, Human
auuucccacugaaaauguuaaacauuuuagauaacugugaagauaguuuauuuuuauuccu

SEQ ID NO: 1578 - RNA, 63 nt, Human
auuuccuaauuuuauuuauuucauacuguaguguacaguauuauaguucuucaauauauagau

SEQ ID NO: 1579 - RNA, 63 nt, Human
auuuccucuggauuaaaacuacggacuggggacaacaguauuaauucgauugaauguggcuga

SEQ ID NO: 1580 - RNA, 62 nt, Human
auuucuauuuguuacuccuuuuuacuggacaugauguuuacaagauacaacuguguuacugu

SEQ ID NO: 1581 - RNA, 61 nt, Human
auuucucggguccuugcagaaaaaaacauacagacugugaacaaaucauucacaaacagaa

SEQ ID NO: 1582 - RNA, 62 nt, Human
auuucuguuaauaaggcuuuuuaccauugauuaaaugaaggaauguaucuuuuugaagagau

SEQ ID NO: 1583 - RNA, 62 nt, Human
auuucuucuguuuuauacaagcucuguuaaguuauguuuacaguaucuuguaucgcuguuua

SEQ ID NO: 1584 - RNA, 61 nt, Human
auuugaccaagauuucuaguagcagagccgguaccugcugaguguccggcacacagaagac

SEQ ID NO: 1585 - RNA, 62 nt, Human
auuugaccccaaaaccuuuuucauauacccaauaauaagcuacagaacuaauauucugcaaa

SEQ ID NO: 1586 - RNA, 57 nt, Human
auuugacuuugaguuauaauuaugguuuugugacuuaugagcugugacucaacugcu

SEQ ID NO: 1587 - RNA, 62 nt, Human
auuugauugacaauauauccaguccaauauaaguaugaaggauucucucuccugagauugua

SEQ ID NO: 1588 - RNA, 63 nt, Human
auuugauuuacacugauuauguuacuccccaaaaggugacuuaauuaauaaagggcauuuggg

SEQ ID NO: 1589 - RNA, 63 nt, Human
auuugccacuugguauugaguacacuggacccugaccacuggcucuugggcaaacguccuucc

SEQ ID NO: 1590 - RNA, 62 nt, Human
auuugcugucagccacauauugagaugacacuaggugcaauagcagggauagauuuuguugg

SEQ ID NO: 1591 - RNA, 50 nt, Human
auuugcuucaaauuuaugauucccugcugauugucaaagcagaaagaaau

SEQ ID NO: 1592 - RNA, 62 nt, Human
auuuggguuuccacucuuuagcuauuaugaauaaugcugcuaugaacauuuguguauaccug

SEQ ID NO: 1593 - RNA, 62 nt, Human
auuuguacuucaauuguacaucuucuaugaauuuaugaaggaccuaccugcuuuaugugauu

SEQ ID NO: 1594 - RNA, 61 nt, Human
auuuguauacccuguccuuucucagagugguucugagauuauuuuaaucuaauucuaagga

SEQ ID NO: 1595 - RNA, 61 nt, Human
auuuguaucuagaaauuuuauuucuuuuuggaaugagauuaaaauacauuuugaaaguucu

SEQ ID NO: 1596 - RNA, 62 nt, Human
auuugugaugccuucccuccccuagaaagauuuugugcaauauauuaaauggggacagaauu

SEQ ID NO: 1597 - RNA, 62 nt, Human
auuuguguuagcuaugggaauaacuugauuuuguauaagcuauuuagagugaggcuggaggu

SEQ ID NO: 1598 - RNA, 63 nt, Human
auuuguucagugucccaccauggucuaugagaaguacacuggaagcguggggggaacacauga

SEQ ID NO: 1599 - RNA, 62 nt, Human
auuuguugaggagaugaggaagaacuuuugaaaaauaagcuauucuauucaguuuugugcaa

SEQ ID NO: 1600 - RNA, 62 nt, Human
auuuguugggcagaggcuguuccauugagaggaauguuuacagcaguuucaaaaaugacaaa

SEQ ID NO: 1601 - RNA, 61 nt, Human
auuuuaaaaaucucuguuguggccuuuauaguuacugugaagccacucuugggccugucuc

SEQ ID NO: 1602 - RNA, 61 nt, Human
auuuuaaaaaucuugcacaaauuguaaugugauacugugaaacaaauugaaaacauugccu

SEQ ID NO: 1603 - RNA, 62 nt, Human
auuuuaaaacaaaaacuaaaaaaaaaaaaaacguugcugcuagacuugggggugauuuugaa

SEQ ID NO: 1604 - RNA, 62 nt, Human
auuuuaaaauguaaaauuaaauuguuauugauuacaguguuauuuuuauggucauaauaaaa

SEQ ID NO: 1605 - RNA, 62 nt, Human
auuuuaacaauguuaauucuugcagaccaugaacauaagcuaccuucccauuuauaugcguc

SEQ ID NO: 1606 - RNA, 64 nt, Human
auuuuaagacugaaauuuuguucuuuaguacuuuucaugcaguagaacggaacuuggggcuggu

SEQ ID NO: 1607 - RNA, 62 nt, Human
auuuuaaguuugcagauuuauuuagugaaggcaagugcaauaauccuuccucagaugauguu

SEQ ID NO: 1608 - RNA, 62 nt, Human
auuuuaaucauugccaucgugugcuuguuucauccaguguuaugcacuuuccacaguuggac

SEQ ID NO: 1609 - RNA, 61 nt, Human
auuuuaccguuuuguugaccuuguacacaagaaugagauuaaucuguauuauauaagaaaa

SEQ ID NO: 1610 - RNA, 62 nt, Human
auuuuaccuacucaggaguauuuugcacuugugacuaccucacuauacccaggacagagaaa

SEQ ID NO: 1611 - RNA, 61 nt, Human
auuuuacuaucugcaugcuguuaacugugguacacugugaaauauguugauuacaaaccca

SEQ ID NO: 1612 - RNA, 63 nt, Human
auuuuaguugcaaaucacugaaaacccaacucaaagugacuuaagucagaaagaaauuuuaug

SEQ ID NO: 1613 - RNA, 63 nt, Human
auuuuauucaaggugauacgaauaauaauagacauacacuggaacagcaguuguugaaauacc

SEQ ID NO: 1614 - RNA, 62 nt, Human
auuuuauuggucaugagaacaaauggaugugaucaugaaggaaucagauucccuauguaaag

SEQ ID NO: 1615 - RNA, 62 nt, Human
auuuucagcauugggcacugaauuaggacaguccucaucucauugcuuggcccuucaagcaa

SEQ ID NO: 1616 - RNA, 61 nt, Human
auuuucagcuauuucuguuccccugaacuaauuugagauuagacccaaacaugcuuuuaaa

SEQ ID NO: 1617 - RNA, 64 nt, Human
auuuucaggcuuauuugacuaagaauuagugccaagaacuggaaagucuacuuuuuggagggaa

SEQ ID NO: 1618 - RNA, 62 nt, Human
auuuucagguaucuuuauagcaaugccccacucccaguauuaauuuucuguauuaguccauu

SEQ ID NO: 1619 - RNA, 62 nt, Human
auuuucagugacuacauaaggauuuguguaacuuaugaaggaagaguccauuucuaaucaaa

SEQ ID NO: 1620 - RNA, 62 nt, Human
auuuuccuaugguuaauguacuguaugguauauauguuuacagaauguaucugccuugugau

SEQ ID NO: 1621 - RNA, 62 nt, Human
auuuucuaagacauuuacaguguauguuuuccuauguuuacaugugcucauuucacgucaug

SEQ ID NO: 1622 - RNA, 62 nt, Human
auuuucucccguauuuguuaccuuccugaggccucaguauuagucgugagcacaaaguuuug

SEQ ID NO: 1623 - RNA, 62 nt, Human
auuuucuucuuauuuuggaugaaguaccccaaccuguuuacauuuagcgauaaaauuauuuu

SEQ ID NO: 1624 - RNA, 63 nt, Human
auuuucuugucgcuuguuuuucuuugaaguuuuauacacuggauuuguuaggggaaugaaauu

SEQ ID NO: 1625 - RNA, 62 nt, Human
auuuugaacagcaacuuuuuaauuaaacaucuuccaguguuaggaaguugagaaacguucau

SEQ ID NO: 1626 - RNA, 62 nt, Human
auuuugcccauacagucuuccuucuguagagggcuguuuacauauacagcacuuaaaauguu

SEQ ID NO: 1627 - RNA, 61 nt, Human
auuuugcuuuuuauccuggcacuggcaaaaagaacugugaaagugaaauuuuauucagccg

SEQ ID NO: 1628 - RNA, 62 nt, Human
auuuuggccuguguugauucuuauucugaauguguguuuacauaauguacaguauauauuca

SEQ ID NO: 1629 - RNA, 64 nt, Human
auuuugguauuguuacgaacauggauaugacaaccaaacuggaaaucagaacacuaggguaaag

SEQ ID NO: 1630 - RNA, 64 nt, Human
auuuuggugcugaguaauuagauuauguauagggguaacuggaagccaugaaggaaggacuuaa

SEQ ID NO: 1631 - RNA, 61 nt, Human
auuuugguucuucauauucuaguauguuuuguuccugcugaauuuuacagacucagcuaaa

SEQ ID NO: 1632 - RNA, 63 nt, Human
auuuuguaguauuuaauaaucuggauggagccugucaguauuacaguuaguuuucuagugacu

SEQ ID NO: 1633 - RNA, 62 nt, Human
auuuugugcuggcuuugaacaauuacgaacaauaaugaaggacaaaugaauccugaaggaag

SEQ ID NO: 1634 - RNA, 61 nt, Human
auuuuguuucucaugaaaaaaccccuuuggcacccugcugauugauuuggaagaaaucuga

SEQ ID NO: 1635 - RNA, 62 nt, Human
auuuuguuuuggagguucucacuuugaaccuucuuguuuacagauuuuuuuguuuguuuuuu

SEQ ID NO: 1636 - RNA, 62 nt, Human
auuuuuaaaauccuaucagcagccuccuaauuagcaguguuaggaauuugccuuauguuuuc

SEQ ID NO: 1637 - RNA, 62 nt, Human
auuuuuaaaguaccuuaaaauugaggauguuacucaguguuaacacaugggaacaccaaaau

SEQ ID NO: 1638 - RNA, 62 nt, Human
auuuuuaaauguacaauuaaauuuuuauuuaccacaguguuauuuuuaucgucauaauaaaa

SEQ ID NO: 1639 - RNA, 62 nt, Human
auuuuuaggaucauagacagugaucauucaggguucaucucacuggacgaguucaggcagac

SEQ ID NO: 1640 - RNA, 62 nt, Human
auuuuuaguuguauucuauucuuuuacuguacauuguuuacaucuggauuuuccuguaauaa

SEQ ID NO: 1641 - RNA, 62 nt, Human
auuuuuaucacacagcuaaagucuguaguuaaguugcugcuacuuuugagucaauaacauca

SEQ ID NO: 1642 - RNA, 63 nt, Human
auuuuuauuacuuaagacuuuaugggagagauuagacacuggagguuuuuaacagaacgugua

SEQ ID NO: 1643 - RNA, 62 nt, Human
auuuuucuaauuauugcuuuuuaaauguauuguuuguuuacauuuaauuuuagcagcagaag

SEQ ID NO: 1644 - RNA, 62 nt, Human
auuuuugaugaaggagaaauacuguaaugaucacuguuuacacuauguacacuuuaggccag

SEQ ID NO: 1645 - RNA, 62 nt, Human
auuuuugauuaacagcuagcacuaucaugaguuacuaccucauuguuacuuucuaaaccagg

SEQ ID NO: 1646 - RNA, 64 nt, Human
auuuuugauuuuguguuacaguacacuuguagccaaaacuggaagacaaaaccaauauauaauu

SEQ ID NO: 1647 - RNA, 62 nt, Human
auuuuuguguaacuuuacuuguaccuauauuuucuguuuacaguucuuuuuaaggggagggg

SEQ ID NO: 1648 - RNA, 62 nt, Human
auuuuuuaccagucuaucauuuggucauuaaauuuguuuacaauauacuuugcuauggccgc

SEQ ID NO: 1649 - RNA, 62 nt, Human
auuuuuuggaagugcaaaaaucucaauuugugucuguuuacagcucucucuccucacugcuc

SEQ ID NO: 1650 - RNA, 62 nt, Human
auuuuuuuagugcugcauuuuuuuaaaguuggauugcugcuauuuaaaaaaaaaaaaaggac

SEQ ID NO: 1651 - RNA, 62 nt, Human
auuuuuuucuaaauuuuuagcauuaguccauuucugcugcuaacaauugaauccagaaaucu

SEQ ID NO: 1652 - RNA, 62 nt, Human
auuuuuuucuauagugaacucugugggcgucucccaguauuacccuggaugauaggaauuga

SEQ ID NO: 1653 - RNA, 62 nt, Human
auuuuuuuuaaaauuaugaaucauaucaaguaguuguuuacauuucuugaaaaaauaggaac

SEQ ID NO: 1654 - RNA, 62 nt, Human
caaaaaaacauaacuauguaaacaagagaauaacugcugcuaaaucaagaacuguugcagca

SEQ ID NO: 1655 - RNA, 64 nt, Human
caaaaacauaacucagucaaaugauauguuaauaugaacuggaaugcaaagugcauacuuuuuc

SEQ ID NO: 1656 - RNA, 62 nt, Human
caaaaagcaaacaugcuuucccugcagcaccuuugugcaauacaacccuauaguaguuacug

SEQ ID NO: 1657 - RNA, 62 nt, Human
caaaaagcaugaacucguuuucauucauuagcccuguuuacaauguggauuuugacauaaau

SEQ ID NO: 1658 - RNA, 63 nt, Human
ccccaugucaggaugccauagugcuguggggagcacaguauuacccaguggguagggcuucug

SEQ ID NO: 1659 - RNA, 62 nt, Human
cccccaccaccaggcuucuauuugggauucacaucaguauuaguaucguagcuacaccaagu

SEQ ID NO: 1660 - RNA, 62 nt, Human
cccccaccgcccaccaccuccuccccuucauuccugcugcuaccccuggucccgagggcugg

SEQ ID NO: 1661 - RNA, 61 nt, Human
cccccagaaaagauuaagaugcuacuugaaaagacugugaagauuuuuuacauugccagau

SEQ ID NO: 1662 - RNA, 63 nt, Human
cccccagcuucucucucccugucacacacuggaccccacuggcugagaaucugggggugagga

SEQ ID NO: 1663 - RNA, 62 nt, Human
ccccccaguccacauggucaccacugcugcuaccagcugcucagugcaguggccacuguguc

SEQ ID NO: 1664 - RNA, 61 nt, Human
ccccccugcccuguggggucaacccuucuggaaacugugaagaucucacucugcccccccc

SEQ ID NO: 1665 - RNA, 61 nt, Human
cccccggacagaccacccagcccuguacagggaccugcugaggaccagccgcgugcacugg

SEQ ID NO: 1666 - RNA, 62 nt, Human
cccccucuauucuccucucucccccaggggauuuucaucucaacaacagagugaaguguaug

SEQ ID NO: 1667 - RNA, 61 nt, Human
cccccugccacagugcacccugaaggagucccuccugcugacagugaaagcaaggaggugg

SEQ ID NO: 1668 - RNA, 62 nt, Human
ccccgaaaucagcccccagccuuguuucugaugacaguguuaucccaagacccugcccccug

SEQ ID NO: 1669 - RNA, 61 nt, Human
ccccgaggaccguccauggaccuuauuuuuauaugagauuaauaaagauguuugccccuca

SEQ ID NO: 1670 - RNA, 61 nt, Human
ccccgaugccacucugcccgccggagggaugugccugcugagccuuuuccuuccacgccgc

SEQ ID NO: 1671 - RNA, 63 nt, Human
ccccgcaaggcccucagagcagcgccugugggugucaguauuaccugagccuaggccaaagcu

SEQ ID NO: 1672 - RNA, 62 nt, Human
ccccuaaagaugcaacccuuaaagauacaguguucaguauuauugaaauaugggcaucugca

SEQ ID NO: 1673 - RNA, 64 nt, Human
ccccuaagacaaaguaacccucaacguuuuaucuuuaugcaguacagugggcuuauuguguuaa

SEQ ID NO: 1674 - RNA, 61 nt, Human
ccccucagaaggucuguuuugaguuccuauaacacugugaagagcuggacucccucaagcc

SEQ ID NO: 1675 - RNA, 62 nt, Human
ccccucauuaacaaaauggaguuuaugauggcaucuaccucacaugguuauugugugguuga

SEQ ID NO: 1676 - RNA, 62 nt, Human
ccccuccacguguuccacccccuuacccugcuguuguuuacauccaaccugccugagaauuu

SEQ ID NO: 1677 - RNA, 61 nt, Human
ccccucccagccacaccugccccugcucuggggccugcugagccggcugcccugggcaccc

SEQ ID NO: 1678 - RNA, 62 nt, Human
ccccuccgugccucagcuuuuuccccacagacaccuaccucacaggggcauugagcagcuca

SEQ ID NO: 1679 - RNA, 61 nt, Human
ccccuccuugacgcucagugaggacgcccgcuuccugcugauugccgccggccggaccauc

SEQ ID NO: 1680 - RNA, 61 nt, Human
ccccucucugccuguucuggacuguguucugggccugcugaggauggcagagcuggugucc

SEQ ID NO: 1681 - RNA, 61 nt, Human
ccccucugagccuuuucuccccaggguauggcuccugcugaguuucuuguccagcagggcc

SEQ ID NO: 1682 - RNA, 61 nt, Human
ccccugacaagcuauuauacaucucugguaaauccugcugaauguaagggauauucagagc

SEQ ID NO: 1683 - RNA, 63 nt, Human
ccccugagguaguugcaggcccacgggcaccccagacacuggaacucccugccucugagccac

SEQ ID NO: 1684 - RNA, 62 nt, Human
ccccugccccuucuacacucuccugggccccucccuaccucaaccuguaaauuauuuuaaau

SEQ ID NO: 1685 - RNA, 64 nt, Human
ccccugguuaaucagucuugucccuacaagucccugaugcaguauguuuauuugugauguuuaa

SEQ ID NO: 1686 - RNA, 61 nt, Human
ccccugugccgcuggcaugagggccguguccccacugugaaggaugaagagcaaggcccuc

SEQ ID NO: 1687 - RNA, 62 nt, Human
ccccuuacauuucaaaggcaucacuauuuuuaaauguuuacauauguuuacauguuugugug

SEQ ID NO: 1688 - RNA, 63 nt, Human
ccccuuccugccauuuucccucccuugaaagguugacacuggacaaccuuggggcagcugagc

SEQ ID NO: 1689 - RNA, 62 nt, Human
ccccuuuccccgcguccgagaaggcggaaacccacaguguuaccugacuuaugaaacuugaa

SEQ ID NO: 1690 - RNA, 62 nt, Human
cccgcaaggcccucagagcagcgccugugggugucaguauuaccugagccuaggccaaagcu

SEQ ID NO: 1691 - RNA, 63 nt, Human
cccgcauuuugcugcauaugccuuuaaaaucaaugcaguauuaccauuaaaacaugggacucu

SEQ ID NO: 1692 - RNA, 62 nt, Human
cccgcccacucugauuugcauuuucauuuguguuuguuuacacauccaugcacugccuguag

SEQ ID NO: 1693 - RNA, 63 nt, Human
cccgccuacacuccuacguguccagggcuugggccgugacuuaggcagaggagugcagaggag

SEQ ID NO: 1694 - RNA, 62 nt, Human
cccgccucacuguggcaguguauugccuguuaauugcugcuaauucuaauucugaugaugac

SEQ ID NO: 1695 - RNA, 62 nt, Human
cccgcuagagcuggaaggcaggaugaggagagguaugaaggagccugagccaugaaguggga

SEQ ID NO: 1696 - RNA, 62 nt, Human
cccgcugggggugggggcggguguccguccggaaaugaaggaauagcccgaggaccgggcug

SEQ ID NO: 1697 - RNA, 62 nt, Human
cccggccccugccccgcccccaagcucggaucacaugaaggagacagcagcacccacccaug

SEQ ID NO: 1698 - RNA, 61 nt, Human
cccggccugagguucccaggagcagcaaaggggccugcugagcucugguuagguuacagcu

SEQ ID NO: 1699 - RNA, 61 nt, Human
cccgucggaccuuggcaugcuccauucagcugaccugcugaggacaggcaucgccgagacu

SEQ ID NO: 1700 - RNA, 62 nt, Human
cccuaaaaaaaaaauguagaauaucucuuaagauuuccguuaugguaaaaaccauaugcaau

SEQ ID NO: 1701 - RNA, 61 nt, Human
cccuaaccuggcuuauucccaacugcucugcccacugugaaaccacuagguucuagguccu

SEQ ID NO: 1702 - RNA, 62 nt, Human
cccuaaugggaaaugaaggggagcugggugugaguguuuacacugugcccuucacgggauac

SEQ ID NO: 1703 - RNA, 62 nt, Human
cccuaccacaauuuacacaauccuguggauaguccuaccucacccuggucaaccuacaugau

SEQ ID NO: 1704 - RNA, 63 nt, Human
cccuagaaaaaauggauucugauugguucugguugcaguauuacaaauuccaaauaaagcuuu

SEQ ID NO: 1705 - RNA, 62 nt, Human
cccuagaucaacagaucaacaauaccuuuuuuuucaguguuaagguaaugguugguuuuugu

SEQ ID NO: 1706 - RNA, 64 nt, Human
cccuagcuuucccauugcuguuccauugcugagacaaacuggaaggcucccuuucuguuugaag

SEQ ID NO: 1707 - RNA, 64 nt, Human
cccuaggccugucucucccuuagcccaaaagaucugaacuggaagcagagguugagauucugcc

SEQ ID NO: 1708 - RNA, 62 nt, Human
cccuaggggcaggaugaagggcugggggacugcccaguguuacuugucaggcugugcugccc

SEQ ID NO: 1709 - RNA, 62 nt, Human
cccuagugauuuuuggauaaggaucacuacugaacaguauuaggcaacuuuucauuuuugcu

SEQ ID NO: 1710 - RNA, 62 nt, Human
cccuauuuuuggcuuuaauuucuaauugcaaagauguuuacaucaaagcuucuucacagaau

SEQ ID NO: 1711 - RNA, 62 nt, Human
cccucaacccaaauccaccuucauacuguaaguagugcaauacuuguuucauuucuguguuu

SEQ ID NO: 1712 - RNA, 62 nt, Human
cccucaccaguuuggacaauuugaaauuaccuauugcugcuacuuguucuguccucugaccu

SEQ ID NO: 1713 - RNA, 64 nt, Human
cccucacucuuuucaucuucugcacguucuucgugaaacuggaaggaucccgggucucagcuag

SEQ ID NO: 1714 - RNA, 63 nt, Human
cccucauucagaugaagggacucaggacaggcucugugacuuacagggacccaaucaauucac

SEQ ID NO: 1715 - RNA, 62 nt, Human
cccuccccagccauccucccgccuugggggcuccaugaaggaugcaggcuuccaggccuggc

SEQ ID NO: 1716 - RNA, 61 nt, Human
cccucccgaguucaagugauucuccuaccucagccugcugaguagcugggacuacaggcau

SEQ ID NO: 1717 - RNA, 62 nt, Human
cccucccuuccccaguuuuucucuaagauauacagugcaauagcuccccaccccucaguuga

SEQ ID NO: 1718 - RNA, 63 nt, Human
cccucgacccgcuguuuacaaccaugaccccuuggacacuggacugcaugcacuuuacauauc

SEQ ID NO: 1719 - RNA, 62 nt, Human
cccucgccacugaaugacuggggccagcucccuaaugaaggaacugaaguuuguuuuuuauu

SEQ ID NO: 1720 - RNA, 64 nt, Human
cccucgccagaggagcacuuggcaaggucagugaggggccaguagacccccggagaagcaguac

SEQ ID NO: 1721 - RNA, 62 nt, Human
cccucucccagacaggagcaggcugccaccccuucuaccucaccacugccccucgaagaauu

SEQ ID NO: 1722 - RNA, 63 nt, Human
cccucucugauucacuuaguaaucuauccucuuuucaguauuacaugugcuuaaucucagaug

SEQ ID NO: 1723 - RNA, 64 nt, Human
cccucucuuucucugguggucuuccuucuaccccaaggccaguaguuuugacacuucccagugg

SEQ ID NO: 1724 - RNA, 61 nt, Human
cccucuuccauguuugaggacccuugugauuacacugugaaaacccagauaagccaggaua

SEQ ID NO: 1725 - RNA, 64 nt, Human
cccugcugaauggaggagccgggggucccccaggccaacuggaaaaucucccaggcuaggccaa

SEQ ID NO: 1726 - RNA, 62 nt, Human
cccuggaauucagcauccaugaaugugcuaguggauaagcuaaauagaaggcagccaaaccc

SEQ ID NO: 1727 - RNA, 63 nt, Human
cccuggagaguggggagaugagaccaguguuccucacacuggagggugauagaccccaagggg

SEQ ID NO: 1728 - RNA, 62 nt, Human
cccuggagcugcuggggccaagccaaggccuccccuaccucaaaccccagcugggcccgcuu

SEQ ID NO: 1729 - RNA, 62 nt, Human
cccuggagggaggcucuucagugcgguagcuauuuguuuacaugcagauuuuuguaauaaag

SEQ ID NO: 1730 - RNA, 62 nt, Human
cccuggcccugccagcugguaguccaucagcacaaugaaggagacuuggagaagaggaagaa

SEQ ID NO: 1731 - RNA, 62 nt, Human
cccuggcuuucaggguggucagaacuggauacgguguuuacaauuccaaucucucuauuucu

SEQ ID NO: 1732 - RNA, 64 nt, Human
cccugggcaucuuaggacuggaggggcuccuuggaaaacuggaagaagucucaacacuguuucu

SEQ ID NO: 1733 - RNA, 62 nt, Human
cccugggcccagauucuuugucucucuucaaccuucaucucaaauugucucuaagcacuacc

SEQ ID NO: 1734 - RNA, 63 nt, Human
cccugggcccaggcuggggacagagcccuuguuuugugacuuaggauuuugaugugguuccca

SEQ ID NO: 1735 - RNA, 63 nt, Human
cccugucagggagugagccggaucugacguuccuugugacuuaaggguccggcuugggaauua

SEQ ID NO: 1736 - RNA, 61 nt, Human
cccugugaaguugauuuaacuuuuggaugucagacugugaaagcuccugagaaacuugggg

SEQ ID NO: 1737 - RNA, 64 nt, Human
cccugugcucccagcucagaggacagucugggccagaacuggaaggagacaucugucccgucuu

SEQ ID NO: 1738 - RNA, 63 nt, Human
cccuucacacucucucccccauccccccaagauacacacuggacccucucuugcugaaugugg

SEQ ID NO: 1739 - RNA, 62 nt, Human
cccuucaccaaugugaacaacuuuuuuucccaaacaguguuaaaagccacuuugcaacacuu

SEQ ID NO: 1740 - RNA, 62 nt, Human
cccuuccauuuccuggcccugcucugcuuccugucuaccucauacuagaaugaucgugacua

SEQ ID NO: 1741 - RNA, 62 nt, Human
cccuuccccaucccaaccccuucuuucucuagauuguuuacauaugaagggcuuuucucucu

SEQ ID NO: 1742 - RNA, 62 nt, Human
cccuucuaagacccacgagcggggugagagaagugugcaauagucuggaauaaauauaaaug

SEQ ID NO: 1743 - RNA, 61 nt, Human
cccuucuccuuugaaugcuguuuugugaaagaaacugugaauguaauggaaacguaggagc

SEQ ID NO: 1744 - RNA, 62 nt, Human
cccuugaacuuugaaccugugaaaugcuuuaccuuguuuacaguuuggcaaaguugcaguuu

SEQ ID NO: 1745 - RNA, 62 nt, Human
cccuugacugcucuuggcuuggucucuacccucacuaccucaguucucaauaacuuagugaa

SEQ ID NO: 1746 - RNA, 62 nt, Human
cccuugaugcaauaguaagugugaugucaucauacaguguuaaugaugcuaucaaauccauc

SEQ ID NO: 1747 - RNA, 62 nt, Human
cccuugcccggcugugauugcugccaggcacuguucaucucagcuuuucugucccuuugcuc

SEQ ID NO: 1748 - RNA, 62 nt, Human
cccuugccuggagcccaggaaccccauccuugcuucaucucaguucuucaugggcuucacuc

SEQ ID NO: 1749 - RNA, 61 nt, Human
cccuugccugggcacccugcaccuuccccuggaccugcugaugcgccuggcugggggaaug

SEQ ID NO: 1750 - RNA, 62 nt, Human
cccuuggauaccaguaauucaaaccuuccucauuucaucucaggugucuccuugcugucauc

SEQ ID NO: 1751 - RNA, 61 nt, Human
cccuuggauuuagaauuauagaacuaaaguaucugagauuacagagaucucagagguuaug

SEQ ID NO: 1752 - RNA, 64 nt, Human
cccuuuagcggcagguauuuauaccugguauuuaugaugcaguauauaaguggugaacaauaac

SEQ ID NO: 1753 - RNA, 62 nt, Human
cccuuuauuuucuuaaaacauuugcucucuuuuuuguuuacagauuaaagaaguauggauca

SEQ ID NO: 1754 - RNA, 62 nt, Human
cccuuuguacuucaaaauauguuuuuguguccaucaguauuaacuauugguauacuacuggu

SEQ ID NO: 1755 - RNA, 63 nt, Human
ccgaaaaucuagccuuauuauacaucugagaguucacacuggagaaaggccuuaugagugcag

SEQ ID NO: 1756 - RNA, 62 nt, Human
ccgaagaccuuuaaagacugugguuuuauuuuuguguuuacauuccuuugguuugaauaauu

SEQ ID NO: 1757 - RNA, 62 nt, Human
ccgaagaggacuagggggcgccaacguucgauuucuaccucagcagcaguuggaucuuuuga

SEQ ID NO: 1758 - RNA, 62 nt, Human
ccgacacguccccguucccccgaaaccuggcucagugcaauacucccauugccauggggucc

SEQ ID NO: 1759 - RNA, 63 nt, Human
ccgacugaaaucacuuugggauauuuuuuccugcaacacuggaaaguuuuaguuuuuuaagaa

SEQ ID NO: 1760 - RNA, 62 nt, Human
ccgagaagcagggugagagauucuaacgacuggaugcugcuaguaacacauuguuuguauug

SEQ ID NO: 1761 - RNA, 64 nt, Human
ccgagagcaggccuguccccuacccaacugggaauaaacuggaagcugggucucuuuguugcua

SEQ ID NO: 1762 - RNA, 63 nt, Human
ccgagcuccagcugccuuaggaggagucacagcauacacuggaacaggagcugggucagccuc

SEQ ID NO: 1763 - RNA, 62 nt, Human
ccgagugauugggguggggggacauucagacgggcaguguuagaggaggagaugggagcggu

SEQ ID NO: 1764 - RNA, 62 nt, Human
ccgcaggcaauuguaacacaguggugaguauuuguguuuacaaacauaggaaagguacagua

SEQ ID NO: 1765 - RNA, 62 nt, Human
ccgcauuuugcugcauaugccuuuaaaaucaaugcaguauuaccauuaaaacaugggacucu

SEQ ID NO: 1766 - RNA, 61 nt, Human
ccgcccccaaccccagcaucagccuguagcuccccugcugaggcagugugguuauguuccc

SEQ ID NO: 1767 - RNA, 62 nt, Human
ccgccugaccugggggagccgaccaauuagucacugcugcuacugccccucuccgaaagaag

SEQ ID NO: 1768 - RNA, 62 nt, Human
ccgcgaacaucacaccguuccccgaccaagccgugugcaauacaacagagggaggcaggugg

SEQ ID NO: 1769 - RNA, 62 nt, Human
ccgcugccacacacuacaggagucaauaaacaaggugcaauauuuuccgugagcaaccuagg

SEQ ID NO: 1770 - RNA, 62 nt, Human
ccggaacgucagccagcucccagccacauggcgcaugaaggagagcccagucucccuccagg

SEQ ID NO: 1771 - RNA, 63 nt, Human
ccggaggucaaggccuugggcucuccccagggucuaacgguuaaggggacccacauaccagug

SEQ ID NO: 1772 - RNA, 62 nt, Human
ccggcaaggccugccgagggcaguuuucaaccucaugaaggaaacacaguccugccaaggag

SEQ ID NO: 1773 - RNA, 62 nt, Human
ccggccauaauuuuauauuuuuagaaaauaaagaaugaaggacaaaagagcacagcuaaaug

SEQ ID NO: 1774 - RNA, 62 nt, Human
ccggcucagucggccagacuuccucuaggaguggugcugcuaccuuguauguuuacauaaug

SEQ ID NO: 1775 - RNA, 61 nt, Human
ccgggagcaggugguguccucagagcagccucgccugcugaccccacugggagaggcgccg

SEQ ID NO: 1776 - RNA, 62 nt, Human
ccgggagggguggggagaauuucgaagauguauuucaucucaagcuugcucuuucucuuccu

SEQ ID NO: 1777 - RNA, 63 nt, Human
ccguacagcucugcgcuccauguucguaagaguucacacuggacaaagccuuaugagagcagc

SEQ ID NO: 1778 - RNA, 62 nt, Human
ccguaguuuaacccuguguauuagucuguucucaugcugcuaauaaagacauaauugaaacu

SEQ ID NO: 1779 - RNA, 64 nt, Human
ccgucagacucuucauggaaacccuuucuucaauugggccaguacgacuucuaaggaaucauag

SEQ ID NO: 1780 - RNA, 62 nt, Human
ccgucuugauugccuuaagaguuacuagcgaggucaguguuaggcuugcaauagggauuuua

SEQ ID NO: 1781 - RNA, 63 nt, Human
ccgugauugacccuaaaaauugcagaccagcacauacacuggacacugcaggcaagguguugg

SEQ ID NO: 1782 - RNA, 62 nt, Human
ccgugcugucucugccccacauuguccuuauguauguuuacauggaugucuccccagcagcu

SEQ ID NO: 1783 - RNA, 63 nt, Human
ccguggccaacgcuugucccuggggccacacagggacacuggaggucacaguuauuuauugau

SEQ ID NO: 1784 - RNA, 62 nt, Human
ccgugggcaggcuccaccugacuagaggauuccaaugaaggacucaaacuggacaccaaauc

SEQ ID NO: 1785 - RNA, 61 nt, Human
ccguucugagccuucauuuccucaucuguacaaugagauuaauaguaccuaucaucuaccu

SEQ ID NO: 1786 - RNA, 64 nt, Human
ccguugaaaggcauagaauugacucuguuccuaacaaugcaguauucucaauuguguuacugaa

SEQ ID NO: 1787 - RNA, 64 nt, Human
ccuaacauuccauaucacuacacugaugugggcuggggccaguaggggcaggacaggugccagg

SEQ ID NO: 1788 - RNA, 62 nt, Human
ccuaacucuguuguuuucaaccucuacguuauuuugcugcuaugugcauuuccagaucugau

SEQ ID NO: 1789 - RNA, 64 nt, Human
ccuaacuguaucuugaggugguaguaaaacacagagggccaguaacgggucguaaugacuuauu

SEQ ID NO: 1790 - RNA, 62 nt, Human
ccuaagaaaacugcuugaauauucuuaucaaugacaguguuaaguuucaaaaagagcuucua

SEQ ID NO: 1791 - RNA, 61 nt, Human
ccuaaggagaaacagagugaggccuuuuuaaccugagauuacagauacuuauaaaacccuc

SEQ ID NO: 1792 - RNA, 61 nt, Human
ccuaagggaugccaauguuuuuaauucucaggaacugugaauauguuaugccacauugcaa

SEQ ID NO: 1793 - RNA, 63 nt, Human
ccuaaucucagguuggggagcucauguuaguagcagugacuuaaggcuaaguguagaagauaa

SEQ ID NO: 1794 - RNA, 62 nt, Human
ccuacaagacuuggaggaauuaagaguucacccuucaucucaccaaauuuuccccauuuuuc

SEQ ID NO: 1795 - RNA, 63 nt, Human
ccuacacacccuuggucacaagccugacucaaacagugacuuauggugggccugccuggcaug

SEQ ID NO: 1796 - RNA, 62 nt, Human
ccuacagggacacuaucacucaugcugguggcauuguuuacagcuagaaagcugcacuggug

SEQ ID NO: 1797 - RNA, 61 nt, Human
ccuacauggccucuaauucuuuggaccauuguaacugugaaacuauggcuuaauacuguua

SEQ ID NO: 1798 - RNA, 61 nt, Human
ccuacauggucucuaguucuuuggacaauuguaacugugaaacuauggcuuaacacuguua

SEQ ID NO: 1799 - RNA, 62 nt, Human
ccuacccaugcuacaggccaggaaccagagcccaucaucucagaggccccuggauguccuuc

SEQ ID NO: 1800 - RNA, 64 nt, Human
ccuacucuaaauacuaccggagucucuuuguagguuggccaguauauguuuuuagugaaauauu

SEQ ID NO: 1801 - RNA, 62 nt, Human
ccuacugcucggggcaggggggcugagccaggaugugcaauagaagcagggguuguccccuc

SEQ ID NO: 1802 - RNA, 62 nt, Human
ccuagaaaaaauggauucugauugguucugguugcaguauuacaaauuccaaauaaagcuuu

SEQ ID NO: 1803 - RNA, 62 nt, Human
ccuagaccccucuuccucucucccccaccauagugugcaauaaagugucuguucuuacccac

SEQ ID NO: 1804 - RNA, 61 nt, Human
ccuagugccugaguuuggggaugggaugcucugccugcugauguggcccugacaggcagcc

SEQ ID NO: 1805 - RNA, 63 nt, Human
ccuagugcucccuuccuccucaaaccgagagacucacacuggacagggcaggaggagggggcc

SEQ ID NO: 1806 - RNA, 62 nt, Human
ccuaguuaugucuggggcccucugggagcuguuaucaucucagaucucuucgcccaucuaug

SEQ ID NO: 1807 - RNA, 62 nt, Human
ccuauauguaguauaaagaaaaguagguuuacauucaucucauuccaacuucccaguucagg

SEQ ID NO: 1808 - RNA, 64 nt, Human
ccuauuggucccauccaugaugcugagacaaacagaaacuggaagcugaagucagugucucugg

SEQ ID NO: 1809 - RNA, 62 nt, Human
ccuauuuuuuuaaaaucacuaacauuauauugcaaugaaggaaauaaaaaagucucuauuua

SEQ ID NO: 1810 - RNA, 62 nt, Human
ccucaacugccccaaaucucuuaauagcuucuagugcugcuacaaucuaagucaggucacca

SEQ ID NO: 1811 - RNA, 63 nt, Human
ccucaaucagaaggagggugaggggucucuggaguaacgguuaugccauucugcagccuuauc

SEQ ID NO: 1812 - RNA, 62 nt, Human
ccucaccuccucuucuagacugcauuagauucauucaucucauuugccaggacauguuggcc

SEQ ID NO: 1813 - RNA, 63 nt, Human
ccucaccuucuccuucuugauuccaaagccuggggaacgguuagggagcucugccuguuggag

SEQ ID NO: 1814 - RNA, 62 nt, Human
ccucacugcacuccagcagaggcuagaggaaugccaguguuaccuuacgcuucuagaagcag

SEQ ID NO: 1815 - RNA, 64 nt, Human
ccucaguuccucagggcuguuggccacccuaugacuaacuggaagaggacacgccagagcuuca

SEQ ID NO: 1816 - RNA, 61 nt, Human
ccucaucuugauuauaguuccaugaauauuaaaugagauuauuucugcucuucaggaaauu

SEQ ID NO: 1817 - RNA, 63 nt, Human
ccucaugacacaaacacugcuaucucccaccucuaacacuggagaugacacuugaacaugaga

SEQ ID NO: 1818 - RNA, 62 nt, Human
ccuccacauaucccuacaugaaauaugggaaaguugcugcuauugauucagggucugucuug

SEQ ID NO: 1819 - RNA, 62 nt, Human
ccuccaccucaauccccucccaucuuccccagaccuaccucaccuacuaggaccugaggcag

SEQ ID NO: 1820 - RNA, 61 nt, Human
ccuccaccuccgcagccagugaaguguguugugccugcugaagugaucaccccccgccccc

SEQ ID NO: 1821 - RNA, 61 nt, Human
ccuccagccagagaagaaucaguauugagggucccugcugacccuuccguacuccuggacc

SEQ ID NO: 1822 - RNA, 62 nt, Human
ccuccagggcccaggaaguugcauuccaagggccuguuuacauggcagcagaauccaucccc

SEQ ID NO: 1823 - RNA, 62 nt, Human
ccucccaccccuucaauguggggacgagacccccucaucucagaguaaugggaagaaccucc

SEQ ID NO: 1824 - RNA, 62 nt, Human
ccucccgggucuccagccuccgaccccucgccccaugaaggagcuggcagguggaaauaaac

SEQ ID NO: 1825 - RNA, 61 nt, Human
ccucccucuccugaauccuuuucuacaugaugcccugcugaccaugcagccgcaccagaga

SEQ ID NO: 1826 - RNA, 62 nt, Human
ccucccuguagucuuuaaaauguuuaacuugccuauaagcuaacauguaauaaaacacauac

SEQ ID NO: 1827 - RNA, 62 nt, Human
ccuccgucuggucuccuguuugcaauugcuucccucaucucaguagggaaaaaauugagugg

SEQ ID NO: 1828 - RNA, 62 nt, Human
ccuccucccuggcccucucguucguuucuguuucuguuuacacguuggagugggguccuccg

SEQ ID NO: 1829 - RNA, 62 nt, Human
ccuccucccuuuguugaauguggugugcagccucucaucucacacugugaguccagcggcgc

SEQ ID NO: 1830 - RNA, 62 nt, Human
ccuccucuaaaaaaagggggucucuaaacaggagcuaccucauaggguuguugaggauuaag

SEQ ID NO: 1831 - RNA, 62 nt, Human
ccuccuggacgggcuggagcugggcuccugccuuugcugcuaacacuggaggcgguguuccu

SEQ ID NO: 1832 - RNA, 61 nt, Human
ccuccuggccugagcgcagcgccuccacccugcccugcugagcacagacggaggaagccgc

SEQ ID NO: 1833 - RNA, 62 nt, Human
ccuccugggccauccagcauggguauugccauccucaucucacccaggggcuuucagcagua

SEQ ID NO: 1834 - RNA, 62 nt, Human
ccucgccucgcugugcugcacugcacggggagcucuaccucauuggggacaacaccaagaag

SEQ ID NO: 1835 - RNA, 62 nt, Human
ccucggcuggauuuucaucaucagauauuucaacucaucucaucaguuucuuguaagaaaaa

SEQ ID NO: 1836 - RNA, 63 nt, Human
ccucgggaagcagucagacugcacucaccucagacacacuggaaaacaguaagagaggagaga

SEQ ID NO: 1837 - RNA, 62 nt, Human
ccucuagcucccacaauucaguguuggguccucugugcaauaucaugaucaucuuccucauc

SEQ ID NO: 1838 - RNA, 63 nt, Human
ccucuagucggcccucuugcugcugccaaccaaaucaguauuagcuuugagcacugcacuguu

SEQ ID NO: 1839 - RNA, 62 nt, Human
ccucuauggccaccacuugcuccucgcccaggagucaucucaugccgccgccucccccagcc

SEQ ID NO: 1840 - RNA, 62 nt, Human
ccucucugauucacuuaguaaucuauccucuuuucaguauuacaugugcuuaaucucagaug

SEQ ID NO: 1841 - RNA, 61 nt, Human
ccucugaaaagagcccugaggcaaacacucucuccugcugaacaggaggcacuguaacccu

SEQ ID NO: 1842 - RNA, 62 nt, Human
ccucugaaccgaauguuuuggacuuaacuguugcgugcaauaugaccgucggcacacugcug

SEQ ID NO: 1843 - RNA, 61 nt, Human
ccucugacauucccucccucccucccgcagggcugagauuagaggguggugauggcuaagg

SEQ ID NO: 1844 - RNA, 62 nt, Human
ccucugccaaacugggaaccagcagugcuaguaacuaccucacagagccccagagggccugc

SEQ ID NO: 1845 - RNA, 63 nt, Human
ccucugcccagagcuguccucaaagcauccagugaacacuggaagaggcuucuagaagggaag

SEQ ID NO: 1846 - RNA, 62 nt, Human
ccucugcuuucgcaggagcucuugugcuugaguucaguguuagugguagcguggcucacucc

SEQ ID NO: 1847 - RNA, 62 nt, Human
ccucuguucacaagagcacgacgugguccccgccugcugcuagucugucugccacugggggc

SEQ ID NO: 1848 - RNA, 62 nt, Human
ccucuuggaauuggauucgccauuuuauuuuucuugcugcuaaaucaccgagcccggaagau

SEQ ID NO: 1849 - RNA, 62 nt, Human
ccugaaaaagcagguauuuucucagaccccagagcaguauuaaugaugcagagguuggagga

SEQ ID NO: 1850 - RNA, 64 nt, Human
ccugaaaauuaaaaccaauauuuauaaaaaguguauaugcaguaugauaccacuuuuaaaaaaa

SEQ ID NO: 1851 - RNA, 64 nt, Human
ccugaacaaagagaugaauaauuccaugggccaguaugccaguuugaauucucagucuccuagc

SEQ ID NO: 1852 - RNA, 62 nt, Human
ccugaacaaugaauucccauuaaugagcagucuucaguauuaaaaccacugucuugucaccu

SEQ ID NO: 1853 - RNA, 61 nt, Human
ccugaacucuuucuagcccuuuuagauuuuggcacugugaaaccccugcuggaaaccugag

SEQ ID NO: 1854 - RNA, 61 nt, Human
ccugaagccugccaaguacccagggucagaggcccugcugagguggggcaaugagcacgag

SEQ ID NO: 1855 - RNA, 63 nt, Human
ccugaagcugaggcucaggggugugccugucuguuacacuggaggagagaagaaugagccuac

SEQ ID NO: 1856 - RNA, 62 nt, Human
ccugaaguuuuagaauggcaaauaaauguacaauuguuuacauaacagaaaaggcuaagcag

SEQ ID NO: 1857 - RNA, 64 nt, Human
ccugaccuccuuuaugguuaauacuauuaagcaagaaugcaguacagaauuggauacaguacgg

SEQ ID NO: 1858 - RNA, 61 nt, Human
ccugacuguuuaguaagagcaugcuuacacccuacugugaaaaggggaggggaugugguaa

SEQ ID NO: 1859 - RNA, 63 nt, Human
ccugagacaaauuuuaacuucuugucuauaguugucaguauuauucuacuauacuguacauga

SEQ ID NO: 1860 - RNA, 64 nt, Human
ccugagcacgguagggccuugcuggguggggucagaggccaguaguuccaggccuuucucugug

SEQ ID NO: 1861 - RNA, 62 nt, Human
ccugagccaagcacagguguuugaggacuacaguucaucucaggguuucuuggaguacaaga

SEQ ID NO: 1862 - RNA, 62 nt, Human
ccugagccuuucccuuuauuggaaacuuuaacugcaguguuaauauauacacugcaaaagac

SEQ ID NO: 1863 - RNA, 61 nt, Human
ccugaggcugcuguggagcgggcauggccgggcccugcugaggaggggccugggcagaggg

SEQ ID NO: 1864 - RNA, 63 nt, Human
ccugaugggaaaaggacauggauuaggacuuuaaaacacuggacagaauuucccacagucuuu

SEQ ID NO: 1865 - RNA, 61 nt, Human
ccugaugucugccauuagcauuggaauaaaguuccugcugaaaaucccugcacaaaugguu

SEQ ID NO: 1866 - RNA, 63 nt, Human
ccugauugacuugccccaagggccacccgaggaagcaguauuaucugcgguggggggaggaga

SEQ ID NO: 1867 - RNA, 61 nt, Human
ccugcaccugcaccccuccucccacugacaugcccugcugaguccugaccagcccagggcu

SEQ ID NO: 1868 - RNA, 62 nt, Human
ccugcaucacuuguuuuaacuauuuauuuugccauguuuacauuuuguaucuuguaaaaaua

SEQ ID NO: 1869 - RNA, 62 nt, Human
ccugcaucuguguuggguggacaugaauacuuagcuaccucagcaggaauuccuuccagguc

SEQ ID NO: 1870 - RNA, 62 nt, Human
ccugcaugccuggcgagcuggggcccagggcagcaugaaggagagcccugcguucugugcuu

SEQ ID NO: 1871 - RNA, 62 nt, Human
ccugccacauaagaucuaguuuuuauuucuagagugcugcuaugaauaauuacuauagcugc

SEQ ID NO: 1872 - RNA, 62 nt, Human
ccugccagguccaauguugucuuagaucugaugaugcugcuauuuacaaaacacugaucguc

SEQ ID NO: 1873 - RNA, 62 nt, Human
ccugcccaucagagaggccugauacaagcaaguuuguuuacaucccuggggaaucuuuuaca

SEQ ID NO: 1874 - RNA, 62 nt, Human
ccugcccuaccaccaccacgcgcucagccugauguguuuacaugguacuguauguaugggag

SEQ ID NO: 1875 - RNA, 62 nt, Human
ccugccgcccgccacccccaucuccaccccaucauguuuacaggguucggcggcagcguuug

SEQ ID NO: 1876 - RNA, 61 nt, Human
ccugccuuccggugggagcagaaaaggccagacccugcugaguuagaggcugcugggaucc

SEQ ID NO: 1877 - RNA, 63 nt, Human
ccugcgaaauccagaacaaagcacaucagaaaaagcaguauuaacuucacagaaaaguaguga

SEQ ID NO: 1878 - RNA, 63 nt, Human
ccugcgcccugacaugcuaaccucucugaacugcaacacuggauuguucuuuuuuaagacuca

SEQ ID NO: 1879 - RNA, 51 nt, Human
ccugcggagggucaagugaggggacacuggaggcugggcucucucgacacg

SEQ ID NO: 1880 - RNA, 62 nt, Human
ccugcuccagaagauagcuucaccccaaucccagcuaccucaaccaaugccaaaaaaagaca

SEQ ID NO: 1881 - RNA, 62 nt, Human
ccugcuggggugugagggcagagggaggguugccaugaaggaacuugggauuuucaauggaa

SEQ ID NO: 1882 - RNA, 62 nt, Human
ccuggaaggagacugcgucuucucucaauuccagucaucucagucguugucguuaggugaca

SEQ ID NO: 1883 - RNA, 61 nt, Human
ccuggagaacuacaguuuagcauuccucaggcuacugugaaaacacaaccguuauggucuu

SEQ ID NO: 1884 - RNA, 64 nt, Human
ccuggagaugugcccuuucauccuuccugcuucccaggccaguagauccguuuacacuuuuggg

SEQ ID NO: 1885 - RNA, 62 nt, Human
ccuggaggaagaaugugccuucaggccacagucgugcugcuagaacagucucguagcugcag

SEQ ID NO: 1886 - RNA, 61 nt, Human
ccuggaggcgcacuaugaggcacugcggcacuuccugcugauggaggacggcgaguucgcc

SEQ ID NO: 1887 - RNA, 64 nt, Human
ccuggcaaaugcacacaccucaugcuagccucacgaaacuggaauaagccuucgaaaagaaauu

SEQ ID NO: 1888 - RNA, 64 nt, Human
ccuggccaacccugcugugcagggugagggccaugcaugcaguaugaggggucuacaccugcaa

SEQ ID NO: 1889 - RNA, 61 nt, Human
ccuggccaucccugggcagcagggccagugucaccugcugaccucuaguauuuccuuugcc

SEQ ID NO: 1890 - RNA, 62 nt, Human
ccuggccccaccccgccacuucccucgggcccuuaugaaggacugaggcuccagggugagaa

SEQ ID NO: 1891 - RNA, 62 nt, Human
ccuggccucuuucgguaccaggaacuggcaaccuucaucucacuccugagggcccaggucuc

SEQ ID NO: 1892 - RNA, 61 nt, Human
ccuggcuagauguuuacauuuguaagaaauaacacugugaauguaaaacagagccauuccc

SEQ ID NO: 1893 - RNA, 61 nt, Human
ccuggcucugugagucuuccaggaccgucccacccugcugacccacagcccaggcccuuua

SEQ ID NO: 1894 - RNA, 62 nt, Human
ccuggcuuuaauaggacugauaccauggaauauuucaucucaccaagaugugacauggauua

SEQ ID NO: 1895 - RNA, 62 nt, Human
ccugggagcgcagguuggccccugaacuguucuuuguuuacaggacucugcuaacuucucac

SEQ ID NO: 1896 - RNA, 61 nt, Human
ccuggggccuccaaccacccccacugguguucuccugcugacagugauuucaauuuuuucu

SEQ ID NO: 1897 - RNA, 62 nt, Human
ccugggggaggggggcagggggugaauuuuacuuucaucucaaguuauuaaaaacccacaac

SEQ ID NO: 1898 - RNA, 62 nt, Human
ccuggggguggggggcgggacucucacggugacauguuuacagcugggugugacucaguaaa

SEQ ID NO: 1899 - RNA, 61 nt, Human
ccuggggguucgcggggugucuucuugccugccccugcugaggcgucuucaggacugcagg

SEQ ID NO: 1900 - RNA, 61 nt, Human
ccugggguauccgggaggauggccgcaccccuuccugcugaucacccaaacguggucuccc

SEQ ID NO: 1901 - RNA, 62 nt, Human
ccuggucugaauuucuuaagguuuuauaaacaaaugcugcuauuuauuagcugcaagaaugc

SEQ ID NO: 1902 - RNA, 62 nt, Human
ccuggugcuauguggccccggagccacagcacaaucaucucaguggcgaagcacaccacuug

SEQ ID NO: 1903 - RNA, 63 nt, Human
ccugguggcagccagggaaaggggaaaggaagaagacacuggaaaugcauggccagcccccua

SEQ ID NO: 1904 - RNA, 62 nt, Human
ccugguggcaggcgggggacaauggccacugucccuaccucacugugccuuccugugcuccg

SEQ ID NO: 1905 - RNA, 64 nt, Human
ccugguuugaauuugaucagcaucaauguuuuuuaaaugcaguaaaaguaauacuaacaugcag

SEQ ID NO: 1906 - RNA, 62 nt, Human
ccuguacuguacucccaguggccaaacuuauuuaugcugcuaaaugaaagaaagaaaaaagc

SEQ ID NO: 1907 - RNA, 62 nt, Human
ccuguccagcacccacccuacccccauaaagcauuguuuacaccugcucuguggagccaggu

SEQ ID NO: 1908 - RNA, 63 nt, Human
ccuguccaggcuccugcagcgccccccucacuuugacacuggacuaggaugcagccucccuuc

SEQ ID NO: 1909 - RNA, 62 nt, Human
ccugugaacugcaaacuugcuuaugauugacuuggugcaauaaaguuccuuucuaaccauuu

SEQ ID NO: 1910 - RNA, 61 nt, Human
ccugugaagugucugacaaaggcagaaugcuugugagauuauaagccuaaugguguggagg

SEQ ID NO: 1911 - RNA, 61 nt, Human
ccuguguacaauuuaaaauauuuguaaaauaucacugugaauuuacagaugucuuuuuguc

SEQ ID NO: 1912 - RNA, 62 nt, Human
ccuguuaauaaaagaauuuacaguuugguaaaauugcugcuaaacaaucauuggaucacaau

SEQ ID NO: 1913 - RNA, 61 nt, Human
ccuguuacucguaggcggggagaggucauggucccugcugaacacaucuggcuguguucag

SEQ ID NO: 1914 - RNA, 62 nt, Human
ccuguucccccagaucuugccuugggaccacauuugcugcuacuuuuccugcugcucuaucc

SEQ ID NO: 1915 - RNA, 64 nt, Human
ccuguucuuccuacauaaaaugcaagaaaacagcauggccaguaaacugagcaagggccuugga

SEQ ID NO: 1916 - RNA, 62 nt, Human
ccuguuucuuucauguacucauuuacuuucaaaaauaagcuagaauauauuaaagaaaauag

SEQ ID NO: 1917 - RNA, 63 nt, Human
ccuuaauucugcuagaguuaaccuugaguucagagcaguauuaaaugcgugcacuuucagguc

SEQ ID NO: 1918 - RNA, 64 nt, Human
ccuuaauuucuugcuccauaacuacucuaucccacgaugcaguauuguaucauuaauuauuagu

SEQ ID NO: 1919 - RNA, 62 nt, Human
ccuuacaaguauaugaguauuauuuauagguaguuguuuacauaugagucgggaccaaagag

SEQ ID NO: 1920 - RNA, 62 nt, Human
ccuuacacagugcauuuuagaaucuuccagucugucaucucagcucuuuuguaacaugcuuc

SEQ ID NO: 1921 - RNA, 62 nt, Human
ccuuauggaaaugaaauaugaaauuuuauuaaaaugcugcuauauugaucauguccuccaag

SEQ ID NO: 1922 - RNA, 62 nt, Human
ccuuaugucuuugguaaugaaacaauaacacucaaugaaggauguauuaaaauuuuugacuu

SEQ ID NO: 1923 - RNA, 62 nt, Human
ccuuauugcauucccaaagaguuguaacauuuuacaguguuaccauuugaguagggguuuua

SEQ ID NO: 1924 - RNA, 63 nt, Human
ccuucaauggaaggagagugcuugggaucgauuaugugacuuaaagucagaauaguccuuggg

SEQ ID NO: 1925 - RNA, 61 nt, Human
ccuucaccuucucaaaaauggaaggaaaaaaaaacugugaauggggaaugcugacugacaa

SEQ ID NO: 1926 - RNA, 61 nt, Human
ccuucagcaggugacugucucugccacuucuuaccugcugaaggaucuugcucaguagcug

SEQ ID NO: 1927 - RNA, 62 nt, Human
ccuucccucaucuuucaucaaucauuguacaguuuguuuacacacgugcaauuuguuugugc

SEQ ID NO: 1928 - RNA, 62 nt, Human
ccuucuccugcugauagcagucagcuugaggaggaugaaggaaggcagccucagacaggaau

SEQ ID NO: 1929 - RNA, 63 nt, Human
ccuucucugucucaugugugcucuucuucuuucuacaguauuauguacucuacugauaucuaa

SEQ ID NO: 1930 - RNA, 61 nt, Human
ccuucuggaacaaagucacuugaaaucucuugaugagauuaaggaguuuaguguuacuaag

SEQ ID NO: 1931 - RNA, 61 nt, Human
ccuucugguuuuaggaaacuuguagaaacgaagccugcugauugauuuuuuucuccuuuuu

SEQ ID NO: 1932 - RNA, 64 nt, Human
ccuucuuacaaaaguagcuauaccguagucaaaccaaugcaguauuguuuuuacauugaaucuc

SEQ ID NO: 1933 - RNA, 61 nt, Human
ccuugaauucuacagcuaccucaguccaggcugccugcugagauccugucuuuagcucaca

SEQ ID NO: 1934 - RNA, 62 nt, Human
ccuugaauugauuuuuuucucauaaaauagucugauaagcuaauuuuuaaaaagaaaugcca

SEQ ID NO: 1935 - RNA, 62 nt, Human
ccuugcaaagguaaucucucauuuuaaaauuggacaguauuaaugaaggggaaauauacaau

SEQ ID NO: 1936 - RNA, 64 nt, Human
ccuugcaauccauuggggucuaguuuggaaucugacaacuggaacaaaaagaaccuugaauccg

SEQ ID NO: 1937 - RNA, 62 nt, Human
ccuugccaguuuuccgaagucucugauuaguugacaguauuaacacuaaauugcaguuuaca

SEQ ID NO: 1938 - RNA, 62 nt, Human
ccuugcguaauugauaagcccaguuauucaguaauguuuacaaauuaauugacuuugauagu

SEQ ID NO: 1939 - RNA, 62 nt, Human
ccuugcucugucaccaggccggagugcaguggugucaucucagaucacugcaaccuccaccu

SEQ ID NO: 1940 - RNA, 62 nt, Human
ccuugcugacuuguguugcauuguauuccaaacguguuuacagguucucuuaagcaauguug

SEQ ID NO: 1941 - RNA, 62 nt, Human
ccuuggcauacucagcauuccucaaaaagaccaucaguguuagcacaaacugagcagaaaaa

SEQ ID NO: 1942 - RNA, 62 nt, Human
ccuuggccagucucugggaacuaaacuccugggauguuuacacaggugcuggguaagauguu

SEQ ID NO: 1943 - RNA, 62 nt, Human
ccuugggucccacugucaccaaggcaaccaguccugcugcuaccugucaccuagagucacac

SEQ ID NO: 1944 - RNA, 64 nt, Human
ccuugguauuucugggucuuucugacaucagcagagaacuggaaagacauagccaacugcuguu

SEQ ID NO: 1945 - RNA, 63 nt, Human
ccuugguuuccccaucuguagaauggggaggguggacacuggaaacuagaugacuucuuucac

SEQ ID NO: 1946 - RNA, 62 nt, Human
ccuugugacuuuuagguaagaaauaggcaugaugauaagcuaugcagauuauuaaaaagcuu

SEQ ID NO: 1947 - RNA, 62 nt, Human
ccuuguugaauucuuacaguuuuuagauggaauuugcugcuauaagaauguccagcuaccau

SEQ ID NO: 1948 - RNA, 62 nt, Human
ccuuguuucucuuuuauuuuuuauuuuuucgcaucaguauuaauguuuuugcauacuuugca

SEQ ID NO: 1949 - RNA, 64 nt, Human
ccuuuagccuucuauauacaucaguggaaacuuaagaugcaguaauuauguuccagauugacca

SEQ ID NO: 1950 - RNA, 63 nt, Human
ccuuucagaauuuuuaccaggaacauaauguggaugugacuuaugaacuuaaauauaaaauaa

SEQ ID NO: 1951 - RNA, 64 nt, Human
ccuuucaguauaagcugaauaaauuuagagcuuucaaacuggaaaaaaaaaugaaacaaaacaa

SEQ ID NO: 1952 - RNA, 62 nt, Human
ccuuucucuuuugugaaucuuuccccccauuuccuguuuacauguaacccaacaaaaugcaa

SEQ ID NO: 1953 - RNA, 62 nt, Human
ccuuucuuacugggaguuggagauuugaagccagucaucucagcacugucugaggagggcag

SEQ ID NO: 1954 - RNA, 64 nt, Human
ccuuucuucucguucuuuaauuugaaaccuagauacaugcaguaaaaacuaggagaaugacuuu

SEQ ID NO: 1955 - RNA, 61 nt, Human
ccuuugaccauguaauaaaugaaccagaagcacugagauuaaccuaucaacgcccugagaa

SEQ ID NO: 1956 - RNA, 61 nt, Human
ccuuuguucccuacccgugcccccagugucuucccugcugaguaccaggagagguccugcc

SEQ ID NO: 1957 - RNA, 62 nt, Human
ccuuuuauacaugaccacuguuucagaccuguacugcugcuauaacaguuaaccuuucuguu

SEQ ID NO: 1958 - RNA, 62 nt, Human
ccuuuugaugccucuauugaauuuuucccaucuuucaucucagggcugacugagagcauaac

SEQ ID NO: 1959 - RNA, 63 nt, Human
ccuuuuuaauuuaaugugcucgcacuacaaugcaucaguauuaugauuccucuguacuuuccu

SEQ ID NO: 1960 - RNA, 61 nt, Human
ccuuuuugguauauuauccguugugccagcucuugagauuacuugcacaauguggcuauaa

SEQ ID NO: 1961 - RNA, 62 nt, Human
cgaacaugauuucaaacaagcagguccucuucucucaucucacguccuuagucucuguuaau

SEQ ID NO: 1962 - RNA, 61 nt, Human
cgaaggaauuaguuuuuccucuucuuuuuuccaacugugaagguccccgugggguggagca

SEQ ID NO: 1963 - RNA, 61 nt, Human
cgaagguuuuuaagucccucugaauugcucaucugagauuaguagaguagcaggccugaag

SEQ ID NO: 1964 - RNA, 62 nt, Human
cgaauauguucuuuggguucugcuguggcccagacaguguuaacuuuuuuuuuauugugggu

SEQ ID NO: 1965 - RNA, 61 nt, Human
cgaauucaaccggaaaagggacguggaaaggccacugugaacugcagagggcugugcacac

SEQ ID NO: 1966 - RNA, 61 nt, Human
cgacaaacuaagggggccucagaggaaaccaacccugcugacaccucaaucuuagacucug

SEQ ID NO: 1967 - RNA, 62 nt, Human
cgacagggaccgcccucuugucaggacaacugccugcugcuagggucuguugccaaggucaa

SEQ ID NO: 1968 - RNA, 61 nt, Human
cgacaugaagaguuuaguuuuuuuacuuuauaaacugugaauaugaguaugccagcugcau

SEQ ID NO: 1969 - RNA, 62 nt, Human
cgaccacuaggggugggcagggccgccccggccauguuuacagccccggcccucgacaguau

SEQ ID NO: 1970 - RNA, 63 nt, Human
cgagaagaacagacgcucuuuaaguuugauuccuaacacuggaguuggccuuaaacaaaacaa

SEQ ID NO: 1971 - RNA, 62 nt, Human
cgagagugaaggaaguugaugcacagaauuuaccucaucucacagagcccacgucgacgagc

SEQ ID NO: 1972 - RNA, 64 nt, Human
cgagcuguaccuggcacggcccauccuggacugagaaacuggaaccucagaggaacccgugccu

SEQ ID NO: 1973 - RNA, 61 nt, Human
cgaggaggguggggcagggaaagggcuggccccccugcugaaaucuugauucugcauuuga

SEQ ID NO: 1974 - RNA, 61 nt, Human
cgaggcucccugaaagccaccgugcugggggcuccugcugaugcuccugucugggccagua

SEQ ID NO: 1975 - RNA, 62 nt, Human
cgaguccugggugcuuacauauuccuucgugucuucaucucacugaccuguguggaccucau

SEQ ID NO: 1976 - RNA, 50 nt, Human
cgagugcgccugcgugugaccccuaccucacucggccggcgcggcggcca

SEQ ID NO: 1977 - RNA, 57 nt, Human
cgauaagaagaccaaguagaagaggagcuucaucucagccugcuagcccccugaccc

SEQ ID NO: 1978 - RNA, 62 nt, Human
cgauccuccuugacgaguuuuguuuuucaaaauggugcaauaauuuaaguggcaucuucucu

SEQ ID NO: 1979 - RNA, 61 nt, Human
cgauggagagaugccagugaccucauaauaaagacugugaacugccuggugcaguguccac

SEQ ID NO: 1980 - RNA, 62 nt, Human
cgcaaccuccgccucccagguucaagcgauucuccuaccucagcccccagaguagcugggau

SEQ ID NO: 1981 - RNA, 62 nt, Human
cgcagccuccgccuccuggguucaagugacucuccuaccucagccuccugaguagcugggac

SEQ ID NO: 1982 - RNA, 64 nt, Human
cgcagguggugaaggggcuucagggaacaaaccggcaacuggaagaggcucuaaagcaucuguu

SEQ ID NO: 1983 - RNA, 62 nt, Human
cgcaugcaggcauguaaauauuugucuggagucacaguauuaaugaaugagaucuuaagcau

SEQ ID NO: 1984 - RNA, 61 nt, Human
cgccaacgcagugcggcuauauggcgugagcuuacugugaaguggagacaggcagggacac

SEQ ID NO: 1985 - RNA, 61 nt, Human
cgccaccagcugggccucagcccucacggcauuccugcugagcaccguggggcacccaggg

SEQ ID NO: 1986 - RNA, 61 nt, Human
cgccagggucuuccuccccaucuuuccauccuuccugcugagcuuccacagagcucguuug

SEQ ID NO: 1987 - RNA, 62 nt, Human
cgccauggggccgcugcugcuuaugugguuggauuguuuacaagccucauuauuaaaacuga

SEQ ID NO: 1988 - RNA, 62 nt, Human
cgccccccuccugccagggccacagaacccguguucaucucauccgagagcggaguuccuca

SEQ ID NO: 1989 - RNA, 62 nt, Human
cgcccccggguccgcccccugacaccgucuuacucuaccucagacaugaggaggcccuccau

SEQ ID NO: 1990 - RNA, 62 nt, Human
cgccccugccuagcagccuucgcggaacucccggcaguguuagacgcguugugggucgggga

SEQ ID NO: 1991 - RNA, 61 nt, Human
cgccgccucugucuccugcuuccccacugaacgccugcugaaugugccgcugacucagcug

SEQ ID NO: 1992 - RNA, 62 nt, Human
cgccuccuguguggugccggaagagcgccagguucaguguuacccugagggcugauuucgcg

SEQ ID NO: 1993 - RNA, 62 nt, Human
cgccucgcugugccagacacaguaggcgcucaaucaguauuaguucccaccauuccccuuuu

SEQ ID NO: 1994 - RNA, 62 nt, Human
cgcgggcgcccuuccaaagcacauacucaccgaauguuuacagacuggcuguccuggcaggg

SEQ ID NO: 1995 - RNA, 61 nt, Human
cgcggggcgagggccuuugcugcucugccggggccugcugacugaaaggaauuuguguuuu

SEQ ID NO: 1996 - RNA, 62 nt, Human
cgcucauuaaaauauuccucugaugugaaauuaaaugaaggauauuaauguaaauuagaugc

SEQ ID NO: 1997 - RNA, 62 nt, Human
cgcugauguacacacauuucauuauuugccaauggugcaauaaccacugcugaccaacgcug

SEQ ID NO: 1998 - RNA, 62 nt, Human
cgcuggacucucagucucugagcagugaaugauucaguguuaaaugugaugaauacuguauu

SEQ ID NO: 1999 - RNA, 62 nt, Human
cgcugguccuuagccccaugccucuuccaaaacagugcaauaaaucuccgguaacccgucca

SEQ ID NO: 2000 - RNA, 62 nt, Human
cgcuggugcugagacaggggcaaggcugcuguuaucaucucauuuuauaaugaagaagaagc

SEQ ID NO: 2001 - RNA, 62 nt, Human
cgcuguacuauuuguguaaauguuuacguaugugauaagcuacauguauguaaauguugcaa

SEQ ID NO: 2002 - RNA, 62 nt, Human
cgcuguuccccaacauccccugagcagugugagcucaucucaccagaugagaagaggcccug

SEQ ID NO: 2003 - RNA, 63 nt, Human
cgcuugaggcucagaagagccucuguccagccccucaguauuaccaugucucccucucagggg

SEQ ID NO: 2004 - RNA, 62 nt, Human
cggagaaagguggacuggaaggggcccgugggagucaucucaaccauccccuccguggcauc

SEQ ID NO: 2005 - RNA, 61 nt, Human
cggagagggacauagaaucugugaccucugacaacugugaagccacccugggcuacagaaa

SEQ ID NO: 2006 - RNA, 61 nt, Human
cggagggguuugggagucaggccugggcaggacccugcugacucguggcgcgggagcuggg

SEQ ID NO: 2007 - RNA, 64 nt, Human
cggaggguguaauaguuuugcugcccaguugugguaggccaguaguggccucccaagaugccca

SEQ ID NO: 2008 - RNA, 62 nt, Human
cggcacccaauucagcagggcugaauccccuucacaguguuaacacaaaagggcaucaccau

SEQ ID NO: 2009 - RNA, 64 nt, Human
cggcaguaaauccacagugaguuggggcgacugugaaacuggaaugcuguuacuuugauaauua

SEQ ID NO: 2010 - RNA, 61 nt, Human
cggccuccugauccggaagcacgcagcauguucccugcugagcggaggcagcccaccuguc

SEQ ID NO: 2011 - RNA, 64 nt, Human
cggccuucccuuggagagggccuggcuucaacauugggccaguaggcaucuuagcuuggcaggu

SEQ ID NO: 2012 - RNA, 62 nt, Human
cgggagaccccaacucccccugaacaauccuuuucaguauuauauuuuuauuauuauuaugu

SEQ ID NO: 2013 - RNA, 62 nt, Human
cgggccacagggcagggccacccucccauucccauguuuacacugagcauuuccucugccug

SEQ ID NO: 2014 - RNA, 62 nt, Human
cggggaaacacaccuaggugcuggugaugggcuuaugaaggaagcuaagcacggcugcucac

SEQ ID NO: 2015 - RNA, 63 nt, Human
cggggauuuuauucaucccgucugagcucuucauacaguauuaccauuagguuuuaagaacaa

SEQ ID NO: 2016 - RNA, 61 nt, Human
cggggccgacucuucucaggggcuguggauagcacugugaagguuuggacuugcuaacagg

SEQ ID NO: 2017 - RNA, 62 nt, Human
cggggcugcggccagggcggagggaggaagacccucaucucagaguagcccuuuccucuguu

SEQ ID NO: 2018 - RNA, 63 nt, Human
cgggggauagugagaaccuaagccccaucguagcacaguauuacaugugguugggaaaaauaa

SEQ ID NO: 2019 - RNA, 63 nt, Human
cgggggugggccguggagucggaguggacaccgcucaguauuacuuucugccgcugucaaggc

SEQ ID NO: 2020 - RNA, 61 nt, Human
cggguccauagagaugagcccacccugcugagaucugcuguccuguuucugucaagcuggu

SEQ ID NO: 2021 - RNA, 64 nt, Human
cggguccucggcuccaugugccagaggcuccgguccaugcaguacaauggcagcuacuucgaca

SEQ ID NO: 2022 - RNA, 62 nt, Human
cgggugcccacagaggcucagcuccuucuuuucugugcaauacgagacccggccgcaccccg

SEQ ID NO: 2023 - RNA, 64 nt, Human
cggguggggggaugggaagggggugcccugaaaccaaacuggaagcccccucugccucccagcu

SEQ ID NO: 2024 - RNA, 63 nt, Human
cggugagcuauguuuacaugacacagugugccaaagugacuuacugcgguugcguuaguuuuu

SEQ ID NO: 2025 - RNA, 63 nt, Human
cgguuucagugcaacuggauggucugcuuuuaaaugugacuuaaucugacugcaguaacuagu

SEQ ID NO: 2026 - RNA, 61 nt, Human
cgguuugccuucaccugguguaguaaaaucaaaugagauuauuugguauguguuuugcuuu

SEQ ID NO: 2027 - RNA, 62 nt, Human
cguaaauuauaguauuuggauggagcaaagucagcaguauuaaugguugaauauuaaugguu

SEQ ID NO: 2028 - RNA, 64 nt, Human
cguagaccucacuguaccacuaacugcaauacugugaacuggaagcaaacaccugccuugccuu

SEQ ID NO: 2029 - RNA, 62 nt, Human
cguaucaauagaucaauugguauuuccuugugaacaguguuauuuauaaagaguucauuauc

SEQ ID NO: 2030 - RNA, 62 nt, Human
cguaucacccauacguccaacaucgaaagaaaaccaguguuaugacuuuguuccauuugaag

SEQ ID NO: 2031 - RNA, 61 nt, Human
cguccccucagacugggugggcagccugggcuuccugcugagacgggaccccccccucucu

SEQ ID NO: 2032 - RNA, 63 nt, Human
cgucccugagguaucugagcguuuaaaguacugagcaguauuagcggaucccgcguaguguca

SEQ ID NO: 2033 - RNA, 63 nt, Human
cguccgauccuaaccguguaugcacccuacagcagcaguauuacucacuagccacagaauacc

SEQ ID NO: 2034 - RNA, 63 nt, Human
cguccucuuugauaucuuuugcaauuguaccgaaagugacuuacuccucugcccuuccugcuu

SEQ ID NO: 2035 - RNA, 61 nt, Human
cguggcucuguguccagggccccagggucugcuccugcugaggaccagcuguggcugggcc

SEQ ID NO: 2036 - RNA, 62 nt, Human
cgugguugucugcuuuccuaaggacucccauuuccaguauuaaagagagaaucaucaucaag

SEQ ID NO: 2037 - RNA, 63 nt, Human
cguguggggcaguguccauccccugcagcuacuuggugacuuaacaacuccaggagcccuguc

SEQ ID NO: 2038 - RNA, 62 nt, Human
cguuaaagaggguccuguuccucucuuccuguugaugaaggagcgugaggguguuagcagug

SEQ ID NO: 2039 - RNA, 55 nt, Human
cguucaugaagaagacuaaggccuacuucaucucaggacccgcccaagaguggcc

SEQ ID NO: 2040 - RNA, 61 nt, Human
cguucauuuaggaaccaacucucucuggauuuaccugcugaguuccagcagcgugaugggc

SEQ ID NO: 2041 - RNA, 61 nt, Human
cguuccaaccuuauauguuccaaggugcagugcacugugaaucuuuuauuuuuaaaaaaau

SEQ ID NO: 2042 - RNA, 64 nt, Human
cguucuggugggggaaaccuguguucaagauucaaaaacuggaaggagcuccagcccugauggu

SEQ ID NO: 2043 - RNA, 62 nt, Human
cguuuccaucauucacagugcccuccccacagcacuaccucaccccgacccccacccucacu

SEQ ID NO: 2044 - RNA, 61 nt, Human
cguuuucuguuuggaggagcaaaggcugagaacacugugaaaacauuuugcgcgcacaaua

SEQ ID NO: 2045 - RNA, 62 nt, Human
cguuuuuugcugcuauggucuuagccuguagacaugcugcuaguaucagaggggcaguagag

SEQ ID NO: 2046 - RNA, 62 nt, Human
cuaaaaaggucagaguaaugcagaaugcgugccuucaucucagauuuguucaucacaggugg

SEQ ID NO: 2047 - RNA, 63 nt, Human
cuaaaaauuuuaucgcuguuaagguauuaaucauucaguauuacuaauggaauagaaauucau

SEQ ID NO: 2048 - RNA, 62 nt, Human
cuaaaauagaaguauauuuugauguuuguuuauucuaccucaaacagaggcuuaaguuuuga

SEQ ID NO: 2049 - RNA, 62 nt, Human
cuaacagacagcugccuccucaaguaucagacuuugcugcuagaggaaucugcaguccaguu

SEQ ID NO: 2050 - RNA, 62 nt, Human
cuaacauuuuucuuuuggagucucauuuuuauuugugcaauauuuucaggcauauaggcuac

SEQ ID NO: 2051 - RNA, 62 nt, Human
cuaaccucuuucuucucaugugccagauguuaagaugaaggaggaauacaacacauacucaa

SEQ ID NO: 2052 - RNA, 61 nt, Human
cuaacucgugcucccuuccgccuucuuuuccguacugugaagaaagaacucuccaccccag

SEQ ID NO: 2053 - RNA, 62 nt, Human
cuaacuggcuauuacuguuuacccauauaaaauaugcugcuaaaguacauauuuugcuguca

SEQ ID NO: 2054 - RNA, 62 nt, Human
cuaacuucauguugaaauugaauugccauucuaacaguguuaagagauggggccuguaagag

SEQ ID NO: 2055 - RNA, 62 nt, Human
cuaagaucguugaagagcaauagaaccuuuaagacaguauuaaaggugugaaacaauggccc

SEQ ID NO: 2056 - RNA, 62 nt, Human
cuaagccaguguuagauuuuguaaacaaguggaacaguguuaaauuucuaugauguuggagc

SEQ ID NO: 2057 - RNA, 62 nt, Human
cuaagccccuacaaguuugagaagguaagaaaagaugaaggagacauauauuaggucagcuc

SEQ ID NO: 2058 - RNA, 62 nt, Human
cuaagcugugguugcagaaaccguggccauuuauauaagcuauaacaucaaaucagggaaaa

SEQ ID NO: 2059 - RNA, 62 nt, Human
cuaaggcaucuuaauagacuucuguugaaaacuucaguguuaacauuuuuauaguuuguacu

SEQ ID NO: 2060 - RNA, 64 nt, Human
cuaauaaaaacacuccucuccuauuaacaaaaaaugaugcaguacccauuuuucguauccugcu

SEQ ID NO: 2061 - RNA, 62 nt, Human
cuaauaacaaaggucaguaaugucaucuucauauaugaaggacacaugugauacauuguucg

SEQ ID NO: 2062 - RNA, 62 nt, Human
cuaauaacauguauagaucuaaagcagguuguguuguuuacauguuucuacacauuucaucc

SEQ ID NO: 2063 - RNA, 64 nt, Human
cuaaugucagaacagagugcaacccagucacacuguggccaguaaaauacuauugccucauauu

SEQ ID NO: 2064 - RNA, 62 nt, Human
cuaauguguuucuuuugacaccuuaguuccuuacuguuuacaguuuaggaguacugauaggg

SEQ ID NO: 2065 - RNA, 64 nt, Human
cuaauuauaugcacugaaauggugggaauuuuagugaugcaguaauugaggagucuggaguuuu

SEQ ID NO: 2066 - RNA, 62 nt, Human
cuaauuuaaaaauuaauauuuucuuauagauauugugcaauaaagcugaaguagaaugugug

SEQ ID NO: 2067 - RNA, 62 nt, Human
cuaauuucuuuuccaacaaggagaacuuaauggcaugaaggauugugugacacauuggaaaa

SEQ ID NO: 2068 - RNA, 63 nt, Human
cuaauuuugacuaaagaaauacuuuugaaguaugacaguauuaagucauaagauuuaaucuca

SEQ ID NO: 2069 - RNA, 62 nt, Human
cuacaaacaaaaaucuuugugucuggacaccuggugcugcuaauuguguucaugguuuccuu

SEQ ID NO: 2070 - RNA, 62 nt, Human
cuacaaguuugcaaauauuuuaacaauauuaaaugugcaauagaacuuuuauaaaauaauua

SEQ ID NO: 2071 - RNA, 63 nt, Human
cuacacugcuucaguggggaccaagcagucauuuggugacuuaggcuagugcuuucuauggga

SEQ ID NO: 2072 - RNA, 62 nt, Human
cuacagaaggaaagagaucuugccuuuugaaaagaugaaggaacaaagguugagagaacauu

SEQ ID NO: 2073 - RNA, 62 nt, Human
cuacagaggcugcaggcuccgccgaguccccccucaguguuauuuuauuuaugacuuacgcu

SEQ ID NO: 2074 - RNA, 64 nt, Human
cuacagcacaguugugcugaaggaccuuuuuguuuuaacuggaagaauaaguauuuuguaaaaa

SEQ ID NO: 2075 - RNA, 61 nt, Human
cuacagccccguugacaugcaugaaacucaguaccugcugacccaggaccuacaaccacac

SEQ ID NO: 2076 - RNA, 62 nt, Human
cuacagcuguuuaugugaggugcccaacacccauucaucucaagugcuucagucuuugguuu

SEQ ID NO: 2077 - RNA, 61 nt, Human
cuacaugacggguugugagacuucuguuugaucacugugaaccaacccccaucucccuagc

SEQ ID NO: 2078 - RNA, 62 nt, Human
cuacauguaguugcacacgguucaguaaaaauaaugcugcuaucgaguaugcaaauauugaa

SEQ ID NO: 2079 - RNA, 64 nt, Human
cuaccaccccuugcucuuugagggcuggcuauugagaacuggaaagaguaaaaugauaacuuac

SEQ ID NO: 2080 - RNA, 62 nt, Human
cuaccucaaccaaugccaaaaaaagacagggcugauaagcuaacaccagacagacaacacug

SEQ ID NO: 2081 - RNA, 64 nt, Human
cuacuaaauauacaggguauguccuaacauggaguuaacuggaauagcaguacacuagcaagua

SEQ ID NO: 2082 - RNA, 62 nt, Human
cuacuaauauuuacuugugauugugugacaaguguguuuacagauuauugguuacacuucaa

SEQ ID NO: 2083 - RNA, 62 nt, Human
cuacuaauggaauaaacuguaauauuagaaauuaugcugcuaauuauaucagcucugaggua

SEQ ID NO: 2084 - RNA, 62 nt, Human
cuacuacagcacugugaugcuuuaugcaacuaacuguuuacauaucuguccccugcuacuag

SEQ ID NO: 2085 - RNA, 63 nt, Human
cuacuacuccacacuacuuagacaucauguaguucacacuggaaaaaggccacguaugugccu

SEQ ID NO: 2086 - RNA, 62 nt, Human
cuacuacugucacagaagaucauagucuuugaugcuaccucacaacacaaacagguaguucg

SEQ ID NO: 2087 - RNA, 61 nt, Human
cuacuagcugccuaagugugcacuuucaaucuaacugugaaagaaucuucugauguuugua

SEQ ID NO: 2088 - RNA, 62 nt, Human
cuacuauuuccgucaaguuucuguuugauuuggaucaucucaggaucggauucuguuuuaga

SEQ ID NO: 2089 - RNA, 62 nt, Human
cuacuauuuuuaaaauuccuguugaguuucuuuguguuuacaaggaaaggacugaacuuuuu

SEQ ID NO: 2090 - RNA, 62 nt, Human
cuacucaguaaaagaacguauuguuguauuccuccaguguuaagcuauagccauguuaaaag

SEQ ID NO: 2091 - RNA, 62 nt, Human
cuacuccagagcuccuuuaacaucugcuaauuaagugcaauaaauuuuucuagaaaauggca

SEQ ID NO: 2092 - RNA, 61 nt, Human
cuacucuagcagagccuuucuugcacuuuaaagugagauuaauuuagcuguaauuugguua

SEQ ID NO: 2093 - RNA, 64 nt, Human
cuacucugcaccugggcuggccucaguugaaggaucaugcaguagauagaggggaggcagggag

SEQ ID NO: 2094 - RNA, 62 nt, Human
cuacuuccuuugcagccuuagucacacaacugagucaucucaaguacucuuuaaggacacac

SEQ ID NO: 2095 - RNA, 62 nt, Human
cuacuugcucuuggccuugagaucguguaacaaaaugaaggagggcucucuucuuucuuccu

SEQ ID NO: 2096 - RNA, 61 nt, Human
cuagaaagaauauuugguuuuccuguauaggaaugagauuaauuccuuuccagguauuuua

SEQ ID NO: 2097 - RNA, 62 nt, Human
cuagaaaggaguuccaaggucaaauuacuuuuuagugcaauaguuaaaugacauuuugagau

SEQ ID NO: 2098 - RNA, 62 nt, Human
cuagaagacagauggaguucuccccugaacuccuugcugcuaagaagugcugagaaguuacu

SEQ ID NO: 2099 - RNA, 62 nt, Human
cuagaauugucagcacuuccaacuucuuguuugacaguguuauuuauguuauuuauauuagc

SEQ ID NO: 2100 - RNA, 62 nt, Human
cuagaccaauucuguguggauauuuaagugaacauguuuacaauuuuuguauauaucacucu

SEQ ID NO: 2101 - RNA, 62 nt, Human
cuagaugaugcugauauuauaaagaguuagucacugcugcuaagcauggaggacuauauaca

SEQ ID NO: 2102 - RNA, 62 nt, Human
cuagauggagucuugggauacugcuggcuuuacucuaccucauauuaaaacuuuuggaauuu

SEQ ID NO: 2103 - RNA, 62 nt, Human
cuagauguacaacacugacucaucauaaauguggugcugcuauucgacaaaccaguuuuagc

SEQ ID NO: 2104 - RNA, 61 nt, Human
cuagcaagaaucaacacuguaucaguccacggaccugcugagcugcagccacuugcucuag

SEQ ID NO: 2105 - RNA, 64 nt, Human
cuagcacuguugauaacacucugaaauauguuauugaacuggaauuguuucuuuaugcuugcau

SEQ ID NO: 2106 - RNA, 63 nt, Human
cuagccuuugagugucugucauggugcauccguuucaguauuauuuccuaaaaugagaagccc

SEQ ID NO: 2107 - RNA, 62 nt, Human
cuagcugucauacaagaaacagcuauuaugagacaugaaggaggguaagaauuagcuuuaag

SEQ ID NO: 2108 - RNA, 61 nt, Human
cuagcuuccugccuugcucccuauucacuuuacacugugaaagguggggggugagucccac

SEQ ID NO: 2109 - RNA, 62 nt, Human
cuaggaauuagaagacagacaccaugucccaggacaguguuacuucuucugcaugaugugug

SEQ ID NO: 2110 - RNA, 63 nt, Human
cuaggauaaucauggcuggaauaaaguaaguuuccacacuggaugauuucggagcagcugaag

SEQ ID NO: 2111 - RNA, 64 nt, Human
cuaggccucaaggagcgcuguugagugacaggucugaugcaguagcuuuuacuauugguggaaa

SEQ ID NO: 2112 - RNA, 62 nt, Human
cuagggccggacccguggcuccuuagacgacagacuaccucacggagguuuugugcuggucc

SEQ ID NO: 2113 - RNA, 62 nt, Human
cuaggggaaaagucauguaguuuuagcuuggcuccaguguuaauauuauauucaguagcagc

SEQ ID NO: 2114 - RNA, 63 nt, Human
cuagggucaauaacccauuauaaaaugaucugauuacacuggacacucuuaggaaguaucaaa

SEQ ID NO: 2115 - RNA, 62 nt, Human
cuagguagaauaaccgaguaugacaauucuuaauuguuuacauuuuauaacuuccuguccuu

SEQ ID NO: 2116 - RNA, 61 nt, Human
cuagguuuggcugucugugacuuacgggaccguccugcugagaaauugcacugaagagaug

SEQ ID NO: 2117 - RNA, 61 nt, Human
cuagugaaaugggcucccagacacaaucacacuccugcugauaaugaugauauacauuuua

SEQ ID NO: 2118 - RNA, 64 nt, Human
cuaguuagaacuuguuacuauuguaaaggaagagucaacuggaaaauucaaggaguuaauaaaa

SEQ ID NO: 2119 - RNA, 62 nt, Human
cuaguucaaaugaugaagaccaaagaccaaguuaucaucucaccacaccacagguucucacu

SEQ ID NO: 2120 - RNA, 62 nt, Human
cuaguugauauccaaguuaugauuuauuuugcaacuaccucaggacagaaaagauuuauggg

SEQ ID NO: 2121 - RNA, 62 nt, Human
cuaguuuaaggugguugauggauuuagccauauaugcugcuaaagaaauugucuaccuuuuc

SEQ ID NO: 2122 - RNA, 61 nt, Human
cuauaaaauauuuuuuugaguuuuuuguguuuaugagauuaugcuaauuuuauggguuuuu

SEQ ID NO: 2123 - RNA, 62 nt, Human
cuauaaucguggaagucagagggauuccccuuuuucaucucauuuuaauaggaaaauuccuu

SEQ ID NO: 2124 - RNA, 62 nt, Human
cuauagaugccccuggcuacccuguuguuuucaucuaccucagaccccuaucauggggcucu

SEQ ID NO: 2125 - RNA, 62 nt, Human
cuauaggccuagaguaugcuacagucacuuaagcauaagcuacaguauguaaacuaaaaggg

SEQ ID NO: 2126 - RNA, 62 nt, Human
cuauaggcuuccuauuuucacuuuacugcucuaaugcugcuagucguagucuuuagcacacu

SEQ ID NO: 2127 - RNA, 64 nt, Human
cuauagugucuacagucuauacucaauaccuauaaaaugcaguaagcauguguuacagaaagag

SEQ ID NO: 2128 - RNA, 62 nt, Human
cuaucagcccauccuccuggaaagccugaaaggaaugaaggaggcuaauaagucaucuucca

SEQ ID NO: 2129 - RNA, 61 nt, Human
cuauccaauuuccugaugaaggacauugccuuuugagauuaaauauugucugauuuagaga

SEQ ID NO: 2130 - RNA, 62 nt, Human
cuaucuauuuaauuggauauuggacucugcucauauaagcuacagacaaaagccaaaagacu

SEQ ID NO: 2131 - RNA, 62 nt, Human
cuauguguguuugucuggagauggccaguucuuucuaccucagagugagugagugaguaugu

SEQ ID NO: 2132 - RNA, 63 nt, Human
cuauuaaguguacugcagagauaauacgacuucagcaguauuaauagcugauuacuuugcagu

SEQ ID NO: 2133 - RNA, 61 nt, Human
cuauucacagcggguggggaaacacacacagcuccugcugacuccccuuauggaucucagu

SEQ ID NO: 2134 - RNA, 62 nt, Human
cuauucucuccaaaaaugcacccaacuagcucuauguuuacaaauggacauaggacucaaag

SEQ ID NO: 2135 - RNA, 61 nt, Human
cuauugguuuuuuuuuuuuaaacagauggaguuacugugaagaaguuuucacaacuauuua

SEQ ID NO: 2136 - RNA, 63 nt, Human
cuauuuaacgaauaguguggaugugauuugucauccaguauuaaguucuuagucauugauuuu

SEQ ID NO: 2137 - RNA, 62 nt, Human
cuauuuacaacucaguuuuacauuuaaauucaggcaguguuaauaugccaagguagggaaug

SEQ ID NO: 2138 - RNA, 62 nt, Human
cuauuuaguagcaugcaggauaccuaaucugaaugugcaauaugcuauucaucaccacgaca

SEQ ID NO: 2139 - RNA, 62 nt, Human
cucaaaaucugggccaagaaugauugcuagguccauaagcuaauuugucuggccuugccauu

SEQ ID NO: 2140 - RNA, 62 nt, Human
cucaaacaagaugcuuuguucuccaacaagauguucaucucaucacuugcacuuuuguuuua

SEQ ID NO: 2141 - RNA, 61 nt, Human
cucaaauuuuuauuucacuaccugcuagagccuacugugaaaucacugcuccauauuugcc

SEQ ID NO: 2142 - RNA, 61 nt, Human
cucaagccccauuuccucacacuaagagggcagacugugaacuugacugggugagacccaa

SEQ ID NO: 2143 - RNA, 63 nt, Human
cucaagucccauggcacagagcaaggcgggcagggaacgguuauuuuucuaaauaaaugcuuu

SEQ ID NO: 2144 - RNA, 62 nt, Human
cucaaguguuuccuagacagagaggcaccugggucaguauuagucuauuuaucagaggugua

SEQ ID NO: 2145 - RNA, 61 nt, Human
cucacaccuuccuaggguugccccaggcccugaccugcugacccugcagcuaugaccucug

SEQ ID NO: 2146 - RNA, 62 nt, Human
cucacauuccuugaagcuaugagcauuuaaaaacuguuuacagccaccauagggauucaaaa

SEQ ID NO: 2147 - RNA, 62 nt, Human
cucaccuuuguggagaggauaaaaccugcccaaccuaccucaccaugguuuuucacauugca

SEQ ID NO: 2148 - RNA, 63 nt, Human
cucacgaccugggacaugccauccucaggccacagacacuggacuuuggucaaguacuagccu

SEQ ID NO: 2149 - RNA, 62 nt, Human
cucacggggagagguaugggagggaagucgccacucaucucagcccaccgcagcccuccagg

SEQ ID NO: 2150 - RNA, 62 nt, Human
cucacuagcaguaggaaaguaacaccuacccugccuaccucacagggcuguugugaggguuc

SEQ ID NO: 2151 - RNA, 63 nt, Human
cucacugaaauaucucucccuuauggcaauccuagcaguauuaaagaaaaaaggaaacuauuu

SEQ ID NO: 2152 - RNA, 62 nt, Human
cucacugucaguauuaaggcccagcagccuguugauaagcuacccugucucaccaugugcug

SEQ ID NO: 2153 - RNA, 63 nt, Human
cucacugugaaaaauaacaguccaccccaagucauacacuggacccagugccugcggggacag

SEQ ID NO: 2154 - RNA, 62 nt, Human
cucagaaacacuccuucaauauuauauuggaucaugcugcuaauguaacuugggcuacaacu

SEQ ID NO: 2155 - RNA, 61 nt, Human
cucagcaggccccgccggcuguccacagcggacccugcugaugccuccaccaucuaugcag

SEQ ID NO: 2156 - RNA, 64 nt, Human
cucagccaggagguccccaaccccaaggaaggaagaaacuggaaauuaggaacugcuuccucau

SEQ ID NO: 2157 - RNA, 61 nt, Human
cucagccuuuuccuccucaguuuucucuuuaaaacugugaaguacuaacuuuccaaggccu

SEQ ID NO: 2158 - RNA, 63 nt, Human
cucagcuugggcuucuuccuccuccaucaccugaaacacuggaccuggggguagccccgcccc

SEQ ID NO: 2159 - RNA, 62 nt, Human
cucaggccaugagcugcagugacugguagggcuguguuuacagucagggccaccccgucaca

SEQ ID NO: 2160 - RNA, 61 nt, Human
cucaggcccccacccuccacuccuccccacgguacugugaacgucgugugacucagugcag

SEQ ID NO: 2161 - RNA, 64 nt, Human
cucaggccucgcuggaugggguuuucuguccauccuaugcaguauuugggaaaguucacaagaa

SEQ ID NO: 2162 - RNA, 64 nt, Human
cucagggucuagggucacagauggugcuauuaauugaacuggaacacagcagaauuguugcaaa

SEQ ID NO: 2163 - RNA, 63 nt, Human
cucaggguucuccccaucugagccagccugcuggugugacuuacucauccuccauuccucugc

SEQ ID NO: 2164 - RNA, 64 nt, Human
cucaggucacauaugaaagcauuuuuacaagauaggaacuggaauuccucauuucucccauguu

SEQ ID NO: 2165 - RNA, 62 nt, Human
cucagguuucccuaagaaaauccuaucacggaacucaucucauagugaaguuuuacauuugu

SEQ ID NO: 2166 - RNA, 62 nt, Human
cucaguauucuuuuucaacauguagggcaagaggaugaaggaaggggcuauccugggaccuc

SEQ ID NO: 2167 - RNA, 64 nt, Human
cucagugaaggucggggucagacacagacagagucaaugcaguaugacugauguuuaagugagg

SEQ ID NO: 2168 - RNA, 62 nt, Human
cucauauggaaaacaccggcugcacuggauucaucaguguuaacuuccuuugaggaagcugc

SEQ ID NO: 2169 - RNA, 64 nt, Human
cucaucaagaacacaguccccauguugagggggaaaaugcaguaauguuugugggagccuggcu

SEQ ID NO: 2170 - RNA, 62 nt, Human
cucaucugcaaaaugggggcaauaugucaucuaccuaccucaaaggggugguauaagguuua

SEQ ID NO: 2171 - RNA, 62 nt, Human
cucaugugaauuuccaaguuuuaauucguucuccaugaaggauuuucauuucagugaaaguc

SEQ ID NO: 2172 - RNA, 63 nt, Human
cucauguuccuuuugaaauuguagugcaaaauggucaguauuaucuaaaugaaugagccaaaa

SEQ ID NO: 2173 - RNA, 62 nt, Human
cucauuauaaguuaguaacaauauauagauuaaauguuuacaauauagggaauuguaaauaa

SEQ ID NO: 2174 - RNA, 62 nt, Human
cucauucauuccuguuaagcugccaaaaauuaaagugcaauauuguauauuuuuaagaacaa

SEQ ID NO: 2175 - RNA, 62 nt, Human
cucauuccccauguguaaaaugggacaacgcaaccuaccucacaggguuguuguggggaugc

SEQ ID NO: 2176 - RNA, 63 nt, Human
cucauucguaccaugccaaacgcauucacucggggcaguauuaaccguucuagaaagccacug

SEQ ID NO: 2177 - RNA, 63 nt, Human
cucauucuuugaauguucucauucuuuuguaucaugugacuuauuaaaaucaguuucuaacga

SEQ ID NO: 2178 - RNA, 63 nt, Human
cucauuuaaucuuuacuacacuccugcaacauagacaguauuauuacauucaguauuacaaug

SEQ ID NO: 2179 - RNA, 61 nt, Human
cuccaagccuuuugcugucuuaagaauaagaccugagauuaacacuaacccuagaauagaa

SEQ ID NO: 2180 - RNA, 61 nt, Human
cuccacauuuccaaaauucagugcaaaaaaagcccugcugagcaucacaugcuggacucuu

SEQ ID NO: 2181 - RNA, 62 nt, Human
cuccacccacccaccuacauuuccucugugaaaucuaccucagaguuguacccucagaagga

SEQ ID NO: 2182 - RNA, 61 nt, Human
cuccagacgcaaagauacacuuuuuuccuuuggacugugaacauggaagccucagccugaa

SEQ ID NO: 2183 - RNA, 62 nt, Human
cuccagaggccugaggcuccagggcuggcucugguguuuacaagcuggacucagggauccuc

SEQ ID NO: 2184 - RNA, 61 nt, Human
cuccagcucaguggagcagugagcagccgacucugagauuagcuggcuucuccacggccgu

SEQ ID NO: 2185 - RNA, 63 nt, Human
cuccaggacaaacuccgccuccccuuaguggaaaccaguauuaacccagagguuugggcaacu

SEQ ID NO: 2186 - RNA, 64 nt, Human
cuccaggugccagccagcaggcuugguggugacagcaacuggaacgaaaguucaguguuguuuu

SEQ ID NO: 2187 - RNA, 62 nt, Human
cuccaguugaacuuagguggaccauuaaacaugcaugaaggagaaaucugagccucagcaag

SEQ ID NO: 2188 - RNA, 63 nt, Human
cuccaucauguuuuaacauacuguauacucuauagcaguauuacagucaguauuucauauaau

SEQ ID NO: 2189 - RNA, 61 nt, Human
cucccaggauuucacaccugagcccugccccacccugcugagaaaacacuccgccacguga

SEQ ID NO: 2190 - RNA, 62 nt, Human
cucccaggcacugucuuaaggcaucugacaugcaucaucucauuuaauccucccuuccuccc

SEQ ID NO: 2191 - RNA, 63 nt, Human
cuccccaugcucuccucccucagccuugcuacccugugacuuacugggaggagaaagagucac

SEQ ID NO: 2192 - RNA, 62 nt, Human
cucccccugccuggcccugagagcggcucugcugucaucucaagcagccccuguccccagcc

SEQ ID NO: 2193 - RNA, 63 nt, Human
cucccccuuacuugcauguaaaucacaaaaacugugugacuuacaaggaaagcacgaggcccu

SEQ ID NO: 2194 - RNA, 62 nt, Human
cuccccuucccuuuuuuuguuauuuuuucagacugugcaauacuuagagaaccuauagcauc

SEQ ID NO: 2195 - RNA, 61 nt, Human
cucccgcucccaguccuagcugcugucuccugcccugcugagaguccucccuccugggcuc

SEQ ID NO: 2196 - RNA, 62 nt, Human
cucccuuuaguuaaguaauagaccaggcagcuucucaucucagcauuuaccuguuaauauuu

SEQ ID NO: 2197 - RNA, 54 nt, Human
cuccgcccgggcuggcugaaagcaaccuaccucaagucucaggagaauucaugu

SEQ ID NO: 2198 - RNA, 62 nt, Human
cuccuaccauccccacgcuuggggcuucccugcucaguguuacugucauucugggaggccuu

SEQ ID NO: 2199 - RNA, 62 nt, Human
cuccucacugccauuauaguuuauuguguggucauguuuacauugugacauccagccccaag

SEQ ID NO: 2200 - RNA, 61 nt, Human
cuccuccaggcagcccaauggggcugguggcuuugagauuauuaaacucuuucucugcugc

SEQ ID NO: 2201 - RNA, 62 nt, Human
cuccuccuccauccccagacaucaccaggucuaauguuuacaaacggugccagcccggcucu

SEQ ID NO: 2202 - RNA, 64 nt, Human
cuccucucgcuucucuggccuugugagguuguggacaacuggaagauucugacucaggaaucca

SEQ ID NO: 2203 - RNA, 62 nt, Human
cuccucugcugggacuccuuugcauggcagggccucaucucaccucucgcaagagggucucu

SEQ ID NO: 2204 - RNA, 64 nt, Human
cuccucuggucucaugaugugcaucuguuaccuugaaacuggaaaccagucuaucaaugucugu

SEQ ID NO: 2205 - RNA, 63 nt, Human
cuccucuguuuucuuuuuaauauacauuuaaaauacaguauuaucacuuuauaaaacauacau

SEQ ID NO: 2206 - RNA, 61 nt, Human
cuccugauuacugaacagagcuccgucauguagccugcugaggaauggaauggaauggaga

SEQ ID NO: 2207 - RNA, 64 nt, Human
cuccugccgucucccccgacuggcuguguccugaguaacuggaacaugagacaguaucugcagg

SEQ ID NO: 2208 - RNA, 63 nt, Human
cuccugcugcuaugccugugacccccgcggcccacacacuggacugaccugcccugagcgggg

SEQ ID NO: 2209 - RNA, 62 nt, Human
cuccugguuuucuuuuguuacaaccacccuugccuguuuacauuaauugcaaggagcauaac

SEQ ID NO: 2210 - RNA, 61 nt, Human
cuccuuaggaauaagacuguagaacuguuuuguacugugaauuacggaugcucuuugaagg

SEQ ID NO: 2211 - RNA, 62 nt, Human
cuccuucacuuugagcaguguucuaauuggauaaaugaaggagaguaguuuuauucugaagg

SEQ ID NO: 2212 - RNA, 62 nt, Human
cuccuucuccaagacucaggccugugggcacucuauaagcuaguugaucuuggcucuccuga

SEQ ID NO: 2213 - RNA, 61 nt, Human
cucgaacauuuucagugucaccacauuguguuuccugcugaaucaagucuacaucacuucg

SEQ ID NO: 2214 - RNA, 62 nt, Human
cucgggggccucucgaggucagccucuccaaccccuaccucagcuccugucugcacugagaa

SEQ ID NO: 2215 - RNA, 62 nt, Human
cucguaaaggucaucucacggaauccaauugcugcuaccucaccauguugcugugcccuggu

SEQ ID NO: 2216 - RNA, 62 nt, Human
cucuaaaaaccauuuaugcuaauguuaaucuuucuguuuacaguaugauaauaaaacagugg

SEQ ID NO: 2217 - RNA, 63 nt, Human
cucuaccuucuaccuuggucuggacacauucuggaacacuggacacccucgccagggccacuu

SEQ ID NO: 2218 - RNA, 62 nt, Human
cucuacuguuuuaagcuuuaguuuccuuuauggaaugaaggauuuggaguagauuauuucaa

SEQ ID NO: 2219 - RNA, 61 nt, Human
cucuagcccugccacuaucauugucuucucuggacugugaagucacugaggacaaggaaac

SEQ ID NO: 2220 - RNA, 62 nt, Human
cucuagucggcccucuugcugcugccaaccaaaucaguauuagcuuugagcacugcacuguu

SEQ ID NO: 2221 - RNA, 62 nt, Human
cucuauauauuuuuaaggcaaugucacuuuguuuuguuuacaaauauauugaauaugucaag

SEQ ID NO: 2222 - RNA, 61 nt, Human
cucuaucaccugagcuccccugcccucuggcuuccugcugaggucagggcauuucuuaucc

SEQ ID NO: 2223 - RNA, 64 nt, Human
cucuccaacaaaaaagggaggugggcugcucugccuaugcaguagccaugcuuuuauuccuuua

SEQ ID NO: 2224 - RNA, 63 nt, Human
cucuccaggcccagcagagcucuucagggguccugacacuggaagaagagaccacuugagcca

SEQ ID NO: 2225 - RNA, 64 nt, Human
cucuccaugacaaauguuuaaucauuaguuacaagaaugcaguaucuggggcgucaacaugggg

SEQ ID NO: 2226 - RNA, 63 nt, Human
cucuccugaugcauuuguaaacaagaagguuucagcaguauuacaccaccucccucaugccuc

SEQ ID NO: 2227 - RNA, 62 nt, Human
cucucuacguuaacguuuccuguaguauguuucuucaucucaucgccaagguaggcuugugu

SEQ ID NO: 2228 - RNA, 62 nt, Human
cucucuagucugaauggcuucauuguuucuuucucaguauuagaaauuauaguuacaaugaa

SEQ ID NO: 2229 - RNA, 62 nt, Human
cucucuaugccauagaauuggauuauccuguaggucaucucauuggguauaagacaaaacua

SEQ ID NO: 2230 - RNA, 62 nt, Human
cucucuauggcucgcgcgauucggcucagauggccuaccucacacacuucgaggaggaugua

SEQ ID NO: 2231 - RNA, 61 nt, Human
cucucugcccccauguuaccuggacuggaacagacugugaauauagcagaagguuccaaga

SEQ ID NO: 2232 - RNA, 62 nt, Human
cucugaggaucaccugcugucaaauugccaucuacaguauuacagcuuugcauuuggggguu

SEQ ID NO: 2233 - RNA, 64 nt, Human
cucugcaacagaugugaucugaucauaggcaauuagaacuggaagaaacuuccaaaaauaucua

SEQ ID NO: 2234 - RNA, 64 nt, Human
cucugcaucagaaccaaguggaagggggcaucagugaacuggaacggcucagaccccauccugu

SEQ ID NO: 2235 - RNA, 61 nt, Human
cucugcccugaccccagccccugccccuggacaccugcugacagcucccacacagaacagu

SEQ ID NO: 2236 - RNA, 63 nt, Human
cucugcccuugaagguaucuucuccaggaaauuagcaguauuauuuucacuucuaagcaaaca

SEQ ID NO: 2237 - RNA, 63 nt, Human
cucugccuuuguucacugugaguucugaugucuuagugacuuaguucuuagaagcucacgccu

SEQ ID NO: 2238 - RNA, 62 nt, Human
cucugccuuuuuaaacaugcuauuaaauguggcaaugaaggauuuuuuuuuaauguuaucuu

SEQ ID NO: 2239 - RNA, 61 nt, Human
cucugcucacccccccaccacucugccuggccuccugcugaugaggacucuaaguucccag

SEQ ID NO: 2240 - RNA, 62 nt, Human
cucugcucccacauuuucacauaccuagcuguuucuaccucauuggguaagucauuuaccac

SEQ ID NO: 2241 - RNA, 62 nt, Human
cucuggcaaaccugugagugauuccacaaagauacaguauuacuuagcuaucugaauuauga

SEQ ID NO: 2242 - RNA, 61 nt, Human
cucuggcacccgaaacuuccacccccgacggcuccugcugacagggcccccacagguggga

SEQ ID NO: 2243 - RNA, 62 nt, Human
cucuggcccuuguuucuagccuccuuccuugcaguguuuacaacauagccaguguuuacagc

SEQ ID NO: 2244 - RNA, 63 nt, Human
cucugggacaagaaaaagaaaacacaagaauguauacacuggaagauuugggccuccugccug

SEQ ID NO: 2245 - RNA, 64 nt, Human
cucugggcagagccagaccauccaguguaccccagaggccaguagguuccugcccauuuuccuc

SEQ ID NO: 2246 - RNA, 64 nt, Human
cucuggucacccgacuccuuucaccaaauugcuccuaacuggaagaucucacuuuccccuugug

SEQ ID NO: 2247 - RNA, 61 nt, Human
cucugguucccucuggugcuguuuucugagcacacugugaacuuccuugcugguaagggug

SEQ ID NO: 2248 - RNA, 62 nt, Human
cucuguguccaggcuugcuccuggcagguggcauucaucucagaugugagcacaaggcauug

SEQ ID NO: 2249 - RNA, 61 nt, Human
cucuguuacacaguggcagcucuugaguuaugcacugugaagaaugagaagggaaaagcaa

SEQ ID NO: 2250 - RNA, 62 nt, Human
cucuguuauggaacaaaucauaacagauuuuaccuguuuacauuucagguaaaaauguaucg

SEQ ID NO: 2251 - RNA, 61 nt, Human
cucuuaaugauaaaacauuuaacaaaaucuauaacugugaagcuuaauucagaggcauuau

SEQ ID NO: 2252 - RNA, 62 nt, Human
cucuuagcguccuugucuuguguguguugacaaacaguguuacugacauugcugccccccac

SEQ ID NO: 2253 - RNA, 64 nt, Human
cucuucacacagaaaucuguagcacugcuuuuuugaggccaguagcaacauccagagaucauuc

SEQ ID NO: 2254 - RNA, 62 nt, Human
cucuuccaaaauugugauguuucuuguauuuuugaugaaggagaaauacuguaaugaucacu

SEQ ID NO: 2255 - RNA, 61 nt, Human
cucuucucaaggcuuugaaaucuccccuugcacugagauuagucgucagaucucuccccgu

SEQ ID NO: 2256 - RNA, 61 nt, Human
cucuucuccaacacuggguauuauaauucaacaugagauuaggguggggacacaaauccaa

SEQ ID NO: 2257 - RNA, 61 nt, Human
cucuucugacugguaacacauagccccaaagcaugagauuauuuuucauuggguuuuuauu

SEQ ID NO: 2258 - RNA, 62 nt, Human
cucuucuuuuaguuggauauucacauuuaucuuucaguguuaacuggguaucaguuaugagu

SEQ ID NO: 2259 - RNA, 62 nt, Human
cucuugaacuuuugguauaguaagguaacucuaacaguauuacugucuuuuucagcaauaac

SEQ ID NO: 2260 - RNA, 61 nt, Human
cucuugcaaugaugugaugaguugccaaauaauugagauuauuuuaaaauguuuuguucau

SEQ ID NO: 2261 - RNA, 62 nt, Human
cucuugcuuuucagcaguagucuggcccaauucucuaccucaaaggaaaguuucaaggauua

SEQ ID NO: 2262 - RNA, 63 nt, Human
cucuuggacuauguauuugacauguaaaauauguacaguauuaacgucaaccaucucuuuaaa

SEQ ID NO: 2263 - RNA, 62 nt, Human
cucuuggggggucagggugcuguccccuccccucuguuuacaucuccccucuaccccgcugu

SEQ ID NO: 2264 - RNA, 62 nt, Human
cucuugguuugauaugguuaccugaauuugcauucaguguuauuuguuaauccauuuacgcu

SEQ ID NO: 2265 - RNA, 62 nt, Human
cucuugugagacucucccaaggugcuguauuuuucuaccucauggaguauucucccagaaac

SEQ ID NO: 2266 - RNA, 61 nt, Human
cucuuuaauauauuuacacaaugaauccaagugacugugaaaaggucucauuacaaugaaa

SEQ ID NO: 2267 - RNA, 62 nt, Human
cucuuuaucacucugcaacaaaucacagaaccgaucaucucaggcuuuuucuucuggcccuu

SEQ ID NO: 2268 - RNA, 64 nt, Human
cucuuucucucucccucuuucucucucucuuucguaggccaguagcaauguuguguucacaguc

SEQ ID NO: 2269 - RNA, 62 nt, Human
cucuuuucucaugcacauguuacguuggagaaaauguuuacaaaaaugguuuuguuacacua

SEQ ID NO: 2270 - RNA, 62 nt, Human
cugaaaaggagauuuugaggccauucuaaucccuuguuuacauuauuagcuuccuacuaaua

SEQ ID NO: 2271 - RNA, 62 nt, Human
cugaaaguuaagagaaggguuuucaagucccggcucaucucaccccagugacuuugacagug

SEQ ID NO: 2272 - RNA, 63 nt, Human
cugaaauagggagacugacugaguagcucauucuugugacuuacagugccaacauuuaaaaaa

SEQ ID NO: 2273 - RNA, 62 nt, Human
cugaaaugccagugcaucuugggggaaagggcuccaguguuaucuggaccaguuccuucauu

SEQ ID NO: 2274 - RNA, 61 nt, Human
cugaacagcuccagucagcagcaguuaccacaaacugugaaucugggccccaccacucuuc

SEQ ID NO: 2275 - RNA, 62 nt, Human
cugaagaauaaguuuccauaagucuccuacauagcaguguuauuuauguacagauaagaaaa

SEQ ID NO: 2276 - RNA, 64 nt, Human
cugaagauucuccccucccuggaaccagggaugugaaacuggaauucucagaugccugaggagc

SEQ ID NO: 2277 - RNA, 61 nt, Human
cugaagccauccccagugagccucgacucugucccugcugaaaauagcugggccagugucu

SEQ ID NO: 2278 - RNA, 62 nt, Human
cugaaggggagcaccgggcgagugcaugugcuacugcugcuacaggccugucuaucuguuug

SEQ ID NO: 2279 - RNA, 64 nt, Human
cugaagguggaacagaccuguuuuuuuccuuuuuaaaugcaguaagguggccuguuuaucacug

SEQ ID NO: 2280 - RNA, 64 nt, Human
cugaauaugaggcauuuggcauuuauuugugaugacaacuggaauaguuuuuuuuuuuuuuuuu

SEQ ID NO: 2281 - RNA, 62 nt, Human
cugaaucuuugauguuuuuugucauuguucucaagugcaauauaacaauguaaccaaaucua

SEQ ID NO: 2282 - RNA, 63 nt, Human
cugaauuuuacuauuuuguugguuugaaaauaugugugacuuacguccuuuaaaggauuuggu

SEQ ID NO: 2283 - RNA, 62 nt, Human
cugacacaggagggcugggcuccacuucauccagaugaaggaaaggaagaccucaagaaaaa

SEQ ID NO: 2284 - RNA, 62 nt, Human
cugacauacuaaaaaaaauaaaaccuaguauuguaugaaggauagcuauucuuuacagcauu

SEQ ID NO: 2285 - RNA, 61 nt, Human
cugacccucacccacuguccaccaaaagccucuccugcugaugggcacuaggagaccucag

SEQ ID NO: 2286 - RNA, 62 nt, Human
cugaccgucccccacagggcucugccucacguccucaucucauuuggcuguguaaagaaaug

SEQ ID NO: 2287 - RNA, 62 nt, Human
cugaccugugaccagguccaauguggggagaaauaugaaggagguagcagcccuggguucuc

SEQ ID NO: 2288 - RNA, 61 nt, Human
cugacgccugagccagcaacuuacucugagcacacugugaagggcggcugugaauuuuucu

SEQ ID NO: 2289 - RNA, 61 nt, Human
cugacggcaguaaauccacagugaguuggggcgacugugaaacuggaaugcuguuacuuug

SEQ ID NO: 2290 - RNA, 62 nt, Human
cugacuuaauuccuuguuuuuaaagaaaggaaaugugcaauauugaagugaucuuuuucccu

SEQ ID NO: 2291 - RNA, 62 nt, Human
cugacuuggcuggugugguacagagaagccagcuuguuuacaugcuuauuccaugacugcuu

SEQ ID NO: 2292 - RNA, 63 nt, Human
cugagaaauccuuucccaggccaggccgcugcgguacacuggaugguucugaagcuggcccau

SEQ ID NO: 2293 - RNA, 62 nt, Human
cugagaagauuuuuuuuuaaugacugagaaaacuuguuuacagcuccagcauauaaggaaag

SEQ ID NO: 2294 - RNA, 62 nt, Human
cugagacaaauuuuaacuucuugucuauaguugucaguauuauucuacuauacuguacauga

SEQ ID NO: 2295 - RNA, 61 nt, Human
cugagacaccuugguuuccuacaugccacagggacugugaacagcuucagggguccugccc

SEQ ID NO: 2296 - RNA, 61 nt, Human
cugagagugguugaguaauuugcccagcugcuaacugugaagcaaaaauuugaaccuuuug

SEQ ID NO: 2297 - RNA, 62 nt, Human
cugagaucacgccauugcacuccagccugggcaacaguguuaagacucugucucaaauauaa

SEQ ID NO: 2298 - RNA, 64 nt, Human
cugagcagaaauggcauguuguauacuaaacguaucaugcaguauuugguuuuauucuguagug

SEQ ID NO: 2299 - RNA, 62 nt, Human
cugagcucuucauucugucaugagaagaggaccaugcugcuaucauuuauuugguccuuuga

SEQ ID NO: 2300 - RNA, 63 nt, Human
cugaggaagaaaaaaaagaggaaggggacugcguuaacgguuacuaaggaaaacuggaaauac

SEQ ID NO: 2301 - RNA, 62 nt, Human
cugaggucggcaagccguggcucccccacacaccgugcaauacccugucugaccugggcucu

SEQ ID NO: 2302 - RNA, 62 nt, Human
cugaguuagggugcaggcagaggcuggggcagaauguuuacagccagugccagcacaaggua

SEQ ID NO: 2303 - RNA, 62 nt, Human
cugauaagccaugguauaauuaacauuauuaaaauguuuacauauaauccuucuuaaaguau

SEQ ID NO: 2304 - RNA, 61 nt, Human
cugaucacaccaugagagccaggaacgggucacccugcugaagaucacucugugcccuggg

SEQ ID NO: 2305 - RNA, 62 nt, Human
cugaucuggagccacagucugucugucuuccaguucaucucaguccucgagaaaggcccuuu

SEQ ID NO: 2306 - RNA, 62 nt, Human
cugaucuuaggaaagagauucaguuuguugcacccaguguuaacacaucuuugucagagaag

SEQ ID NO: 2307 - RNA, 62 nt, Human
cugaugcaagccuuuuucaguucaagagaauaaauguuuacaaauagccaccuuuggacccu

SEQ ID NO: 2308 - RNA, 62 nt, Human
cugaugcagcuguccugaaggacuccccgaggagcuaccucaucaaaaaauacaguuuccac

SEQ ID NO: 2309 - RNA, 62 nt, Human
cugaugcguagaugugagaggauguuuucuggcacaguguuaugaaaauacaagauaaauga

SEQ ID NO: 2310 - RNA, 64 nt, Human
cugauggaacuagucuuccuuccuuauuccucgaacaugcaguacauaaaaaggggaaaaggag

SEQ ID NO: 2311 - RNA, 62 nt, Human
cugauguguauauacaucauuacuguccguagcaaugaaggauacaguacuguguugugggu

SEQ ID NO: 2312 - RNA, 62 nt, Human
cugauugacuugccccaagggccacccgaggaagcaguauuaucugcgguggggggaggaga

SEQ ID NO: 2313 - RNA, 64 nt, Human
cugcaaaguguuuuguaccagugaauuuuugcaauaaugcaguaugguacauuuuucaacuuug

SEQ ID NO: 2314 - RNA, 62 nt, Human
cugcaacuuucuauaaugccaaaaugacacaucugugcaauagaaugaugucugcucuaggg

SEQ ID NO: 2315 - RNA, 62 nt, Human
cugcaagaauuucuuuuaaauaaaaaguuugggggugcaauauaagaaguuuauauaauaug

SEQ ID NO: 2316 - RNA, 52 nt, Human
cugcaaguucaaaaacuagaaggcaacuggaaaauacaugucuagaacugau

SEQ ID NO: 2317 - RNA, 62 nt, Human
cugcacaguucucucuucuccuuguccuagucagaugaaggaggcugcacuacaaacccaaa

SEQ ID NO: 2318 - RNA, 62 nt, Human
cugcacuuccugucuguacaauagaagggggaggugcugcuaugaaggggagaguuuagacc

SEQ ID NO: 2319 - RNA, 61 nt, Human
cugcagacaggaaagguugucccuaaggacucaugagauuagguugggcccagccagauaa

SEQ ID NO: 2320 - RNA, 62 nt, Human
cugcagcacugcagaaaugccucugcguggugccaugaaggaaagaaaccuuggccuggucu

SEQ ID NO: 2321 - RNA, 62 nt, Human
cugcagccuccccucccgaguucaagugauucuccuaccucagccugcugaguagcugggac

SEQ ID NO: 2322 - RNA, 62 nt, Human
cugcagccuccgccugccgggucaagcgauucuccuaccucagccuccucaguagcugagau

SEQ ID NO: 2323 - RNA, 62 nt, Human
cugcagcuuugaucugaccgcucaagggguuauucuaccucagccuccugaauagcugggaa

SEQ ID NO: 2324 - RNA, 62 nt, Human
cugcaggcggaacugagaccagccucucugggcgaugaaggacaauggugguagggccacuu

SEQ ID NO: 2325 - RNA, 62 nt, Human
cugcaguggaacuguccuugcuacccucagacugaugaaggagcuaacacccuuaucuacac

SEQ ID NO: 2326 - RNA, 61 nt, Human
cugcauugcuggaacugugucaagagagcagagugagauuaaagagcgagaaagcaccuga

SEQ ID NO: 2327 - RNA, 62 nt, Human
cugccaaguacaaugaccucuuccucugaaacaucaguguuacccucaucccuguccccagc

SEQ ID NO: 2328 - RNA, 64 nt, Human
cugccaccugcuggauguuaaaagguauuucaguacaacuggaauuuaaauauuuccauuguuu

SEQ ID NO: 2329 - RNA, 62 nt, Human
cugcccagcauacuuaaaaaguagauccuugggcauaagcuaagcaccuuauuugcuuauca

SEQ ID NO: 2330 - RNA, 64 nt, Human
cugcccagcucaugauguccgugaggcuguccuuuuggccaguagccgugugcagcuguguggc

SEQ ID NO: 2331 - RNA, 63 nt, Human
cugcccagucuggugccugccccacauuguaccggacacuggauuccuggacccccuucuccu

SEQ ID NO: 2332 - RNA, 63 nt, Human
cugccccaggacugaaguggguaccugccuccuguacacuggagcaaggaccaagaggaaaug

SEQ ID NO: 2333 - RNA, 62 nt, Human
cugccccggagacuuuucaaucccaccccacuccucaucucaccauuuggucaaauuggaag

SEQ ID NO: 2334 - RNA, 63 nt, Human
cugcccuuuuaauuacaccugauuauacuacugaagugacuuaugguugcuccccuagacagc

SEQ ID NO: 2335 - RNA, 62 nt, Human
cugccucagugacaaugucccagcgcuccuaucauguuuacagucacccuuggguccuaaau

SEQ ID NO: 2336 - RNA, 61 nt, Human
cugccugucuccuuugcaggcucauagggaagaccugcugagggaccagccaagagggcug

SEQ ID NO: 2337 - RNA, 62 nt, Human
cugcgaaauccagaacaaagcacaucagaaaaagcaguauuaacuucacagaaaaguaguga

SEQ ID NO: 2338 - RNA, 62 nt, Human
cugcguuuucuggaccguuccaugggacucaucccuaccucacagggcuguugugagguguu

SEQ ID NO: 2339 - RNA, 62 nt, Human
cugcuaaaauggaaaauaagagaggaaagccuucauaagcuaaauaacaagggaaagucuuu

SEQ ID NO: 2340 - RNA, 62 nt, Human
cugcuaaaauggaaaauaagagaggaaagccuucauaagcuaaauaagaagggaaagucuuu

SEQ ID NO: 2341 - RNA, 62 nt, Human
cugcuaaguagauguuucugaguauuagaaaaaucaguguuauuaccugcaggauauuaaaa

SEQ ID NO: 2342 - RNA, 62 nt, Human
cugcuagaaaucugugcuugaaguccucucuuucugcugcuagccuaccaguuaaaagucaa

SEQ ID NO: 2343 - RNA, 62 nt, Human
cugcuagaugucaucucuggauugcacauggaugaugaaggaacucagcauugaaaguuggg

SEQ ID NO: 2344 - RNA, 62 nt, Human
cugcuagugcagucauucaugcucauguccccaguguuuacauguccuuuggaugccaagau

SEQ ID NO: 2345 - RNA, 64 nt, Human
cugcuccacuacugcuccucagccaucuuuaccaaaaugcaguauuuacugucccagccucucu

SEQ ID NO: 2346 - RNA, 64 nt, Human
cugcucccagaauguccugugaugcaugauucuaagaacuggaagaaccuggugguuccauuug

SEQ ID NO: 2347 - RNA, 62 nt, Human
cugcuccccgucagguugugcugucucugaccuauguuuacauccccgagggguuucugccu

SEQ ID NO: 2348 - RNA, 62 nt, Human
cugcuccguccccgcuuccuagcugcccacuuuucaguguuacgaagccuggggaccggggc

SEQ ID NO: 2349 - RNA, 62 nt, Human
cugcuccuccaugaaugacaauuccaggccuccccuaccucauguccucucauuugggggau

SEQ ID NO: 2350 - RNA, 61 nt, Human
cugcugcuuuccugacagcuuacucuuccuccaccugcugagccugugccagacuccauug

SEQ ID NO: 2351 - RNA, 62 nt, Human
cugcuggaaaucacugcuuucauucccacaaaaccaguauuacuuuuuuuuaaaaaaagaaa

SEQ ID NO: 2352 - RNA, 62 nt, Human
cugcuggccgaagaugucaccaaggccaaagacacaguauuaugaagguuuggaaaccccuc

SEQ ID NO: 2353 - RNA, 61 nt, Human
cugcugugaugccguccugcuggagugauuuauacugugaaaugaguuggccagauugugg

SEQ ID NO: 2354 - RNA, 62 nt, Human
cugcuugcugccauaugugacaaaucaccaccaccaguguuaagugcuucuggauucauggg

SEQ ID NO: 2355 - RNA, 61 nt, Human
cugcuuguuauuccagcacauuccagggugaugccugcugaagccacgcagccagugccuc

SEQ ID NO: 2356 - RNA, 61 nt, Human
cuggaaagcaaacaggaagauucccggagggaaacugugaaugcuucugauuuagcaaugc

SEQ ID NO: 2357 - RNA, 62 nt, Human
cuggaacugaaaguuccaguugggaugaagcauuucaucucacuucauaacaccucuuugac

SEQ ID NO: 2358 - RNA, 61 nt, Human
cuggacaaagcuuggcugccggcuucauuuauuccugcugauggcugagaagcaucugucu

SEQ ID NO: 2359 - RNA, 61 nt, Human
cuggacagcacucugccauccugauacaugaccccugcugaugccacagagaauaagcuga

SEQ ID NO: 2360 - RNA, 62 nt, Human
cuggagaauugccagacuugugguaccgauuauaucaucucagucuugaauuuacucacgcu

SEQ ID NO: 2361 - RNA, 61 nt, Human
cuggagacuaaaccuggugcucaggagcgaaggacugugaacuuguggccugaagagccag

SEQ ID NO: 2362 - RNA, 61 nt, Human
cuggagauguucuagacuugcuucucccaccucugagauuaggacaggaaaaaugugaaau

SEQ ID NO: 2363 - RNA, 62 nt, Human
cuggagcaaguggagugguugcaggcagaugagacaguguuauaucaggauuuuucaaucaa

SEQ ID NO: 2364 - RNA, 61 nt, Human
cuggagcauuguguauagaacuggauuuucagaccugcugaggaccguaaggccugaugga

SEQ ID NO: 2365 - RNA, 62 nt, Human
cuggaggcaggcugucucucaagguggucucuucugcugcuagcaacucaaaaaucccaaca

SEQ ID NO: 2366 - RNA, 61 nt, Human
cuggagguauuugcugcucaugcuggccgcaagacugugaagccagaggaccuggagcugc

SEQ ID NO: 2367 - RNA, 62 nt, Human
cuggauacacauggagcuguuugggaauuuuccuugcugcuaccgcgcugccaccaaaugga

SEQ ID NO: 2368 - RNA, 62 nt, Human
cuggaucuuuccacauuucagcagcaccaacaucugcugcuacucaaaauguccuguugaag

SEQ ID NO: 2369 - RNA, 64 nt, Human
cuggauucauugaugaauacaaguacccacaccuuuggccaguaaugucaguuaccugcugcag

SEQ ID NO: 2370 - RNA, 62 nt, Human
cuggauuucuguuuccagaccuauaaaccauguaaugaaggacugaaauucguuuggcauac

SEQ ID NO: 2371 - RNA, 64 nt, Human
cuggccaucacucauguguaguccagguuugagaggaacuggaaggggggugaggguggggagg

SEQ ID NO: 2372 - RNA, 62 nt, Human
cuggccccauccucacuuccucuuuuuauuucacugcugcuaaaauuguguuuuuaccuacu

SEQ ID NO: 2373 - RNA, 62 nt, Human
cuggcuccuguguucccucuauccagccaaugccuguuuacacagacaccuggccucacugc

SEQ ID NO: 2374 - RNA, 61 nt, Human
cuggcugggaaaggggaccaggagugcagggcaccugcugaggacucaccuaagcccaaga

SEQ ID NO: 2375 - RNA, 62 nt, Human
cugggaaaacugggguuugcaucacuccacugcacaguguuagugggaccugggggcaaguc

SEQ ID NO: 2376 - RNA, 64 nt, Human
cugggaaguaaagaguaaaccuggggcagugggucaggccaguaguuacacucuuaggucacug

SEQ ID NO: 2377 - RNA, 62 nt, Human
cugggagcguggaaggagaugcuaggcccuggcacaguguuauguggacugggccacgauag

SEQ ID NO: 2378 - RNA, 62 nt, Human
cugggaguuuggacgcuuagcuccuaccccuguccuaccucaccggggcacuuucaggggcc

SEQ ID NO: 2379 - RNA, 62 nt, Human
cugggaugucgggagaccuagaugaccuuaucgggugcaauacuagcuaagguaaagcuaga

SEQ ID NO: 2380 - RNA, 63 nt, Human
cugggauuuauuggaugcuguaaaaaaauaaauuuacacuggauaugcgaaggguuuggaucu

SEQ ID NO: 2381 - RNA, 62 nt, Human
cugggcagagacuuauuaauuaauuuugcauuuacuaccucagagcucagaagaaacuccga

SEQ ID NO: 2382 - RNA, 62 nt, Human
cugggcccugacugugcguccacugcugucuucccuaccucaccaggcuacuggcagcagca

SEQ ID NO: 2383 - RNA, 62 nt, Human
cugggcugccagcaguacgugggaaagguggaaugugcaauaggaacagaucugugcauuuu

SEQ ID NO: 2384 - RNA, 61 nt, Human
cugggcugcugcgacacaggcagcgcuuuguaaacugugaagccauauacgugaaacugaa

SEQ ID NO: 2385 - RNA, 63 nt, Human
cugggguggccugggggugggggugggcaaggcugacacuggaaaauggguuuuugcacuguu

SEQ ID NO: 2386 - RNA, 62 nt, Human
cugggugacugggucuagccccugaucccaaaucuguuuacacaucaaucugccucacugcu

SEQ ID NO: 2387 - RNA, 62 nt, Human
cugggugugaccccagggcccuggucugguuggaaugaaggaugauggcugccucaggcgcu

SEQ ID NO: 2388 - RNA, 63 nt, Human
cuggguuuggccugcaggcuguagcuugccaaucagugacuuaaauuguugauuuuuguuuga

SEQ ID NO: 2389 - RNA, 64 nt, Human
cuggguuuuuuccccuuuucuuuuuuuaguuuagagaugcaguaacaaaacuguugcaaagcac

SEQ ID NO: 2390 - RNA, 63 nt, Human
cugguauaugguuaauguguaaaacaagguucuaacaguauuacugaauauuaauguuucuug

SEQ ID NO: 2391 - RNA, 62 nt, Human
cuggucgacuuuuuaaaaaacaugaucacacuguauaagcuacuuagaacuuugaagggcau

SEQ ID NO: 2392 - RNA, 61 nt, Human
cuggugguaggugggaagcaugguguccaccugccugcugaccacuggacgcugcuccaug

SEQ ID NO: 2393 - RNA, 61 nt, Human
cuguaaauguguauauuugguguuccuauuuaaugagauuauuuaauaaggguguacagua

SEQ ID NO: 2394 - RNA, 62 nt, Human
cuguaauaaauaaaaugguaguaaugaaugcaaucaguauuagccaaaauaaagaauuuaug

SEQ ID NO: 2395 - RNA, 62 nt, Human
cuguaaucacuaagggcccaggaugauggaagcuucaucucaacacaugccuccacaaucac

SEQ ID NO: 2396 - RNA, 62 nt, Human
cuguaauuucugaauguauauagaauaauauuuauguuuacaauguaacuuuucaaaauuua

SEQ ID NO: 2397 - RNA, 64 nt, Human
cuguaccuuugacuaacgcucagcuuccgggccugcaugcaguagacagaagaggaagaaagaa

SEQ ID NO: 2398 - RNA, 62 nt, Human
cuguacugugccucccaguuuacaaacacgcccuucaucucaaguggcccuuuaaaaggccu

SEQ ID NO: 2399 - RNA, 61 nt, Human
cuguagagacaguguugagaggaaaggggagguccugcugauuccucagaauggcuucugg

SEQ ID NO: 2400 - RNA, 63 nt, Human
cuguagcuccuguuacccacccagagccaggcgccacacuggaggcucccaggcgggagggcc

SEQ ID NO: 2401 - RNA, 61 nt, Human
cuguagucuugggcaagucaccuauaaacucacugagauuauuuuuucaucuguaaaaugg

SEQ ID NO: 2402 - RNA, 63 nt, Human
cuguauaccuguuccaaaacaccacaucucacucagugacuuauuucucauuaugcuaauugu

SEQ ID NO: 2403 - RNA, 63 nt, Human
cuguauuauuaaauaaauaauuuucaaauguuaaacaguauuaaauggcaccugauuuugugu

SEQ ID NO: 2404 - RNA, 64 nt, Human
cuguauuuccuuucuaaauaaaauugauuugauuguaugcaguacuaaggagacuaucagaauu

SEQ ID NO: 2405 - RNA, 62 nt, Human
cugucaucucauucuuguacaacguagaauuacuuguuuacauccaacaaaugguuagcuag

SEQ ID NO: 2406 - RNA, 62 nt, Human
cugucauuuuucugugcgugcagugaaaauggccucaucucauaccauggcuccaccuucca

SEQ ID NO: 2407 - RNA, 62 nt, Human
cuguccagaacugaagacuuuaaaauuuuguuacuguuuacaaguccagauucaaaaaaugu

SEQ ID NO: 2408 - RNA, 61 nt, Human
cuguccaguccuggccgggccaaggccugggaaacugugaaagucagaaaggccagcgggg

SEQ ID NO: 2409 - RNA, 62 nt, Human
cugucccaagcuacuguuugguggggaucuggguucaucucacccacagagggaggaucuuu

SEQ ID NO: 2410 - RNA, 63 nt, Human
cugucuauuauucauucaacucuuuuuacagaccucaguauuagucugugacuacaaaauauu

SEQ ID NO: 2411 - RNA, 62 nt, Human
cugucucaguacaauccaaauuugucguagacuugugcaauauauacuguuguggguuggag

SEQ ID NO: 2412 - RNA, 62 nt, Human
cugucuccccuuauucaccccuguccucugaagcuguuuacacuuuucucuuugccuuuucu

SEQ ID NO: 2413 - RNA, 63 nt, Human
cugucuccucuccugggaaggagugagggugggacgugacuuagacaccuacaaaucuauuua

SEQ ID NO: 2414 - RNA, 64 nt, Human
cugucuccugguuccaaccaggccgccuucuagugcaacuggaauucccaccuccugguauuuc

SEQ ID NO: 2415 - RNA, 62 nt, Human
cugucucucuuuauacauccuuguaugguucucccaguauuagcaagauuguauaucuguaa

SEQ ID NO: 2416 - RNA, 62 nt, Human
cugucucuuugagcuggcucuugucacuuaggucucaucucaguggccgcuccugggccacc

SEQ ID NO: 2417 - RNA, 62 nt, Human
cugucuugcagacagagacccuuggcuaccacugugcugcuaauaggauaaguacucuguug

SEQ ID NO: 2418 - RNA, 62 nt, Human
cugucuuguuucaggagccaccauguuuuuuuuucaguguuaacaacaaucaugauaauuaa

SEQ ID NO: 2419 - RNA, 62 nt, Human
cugucuuugccuugucuccucccaaguuggaaaauguuuacaugaauuaauaaacagauuua

SEQ ID NO: 2420 - RNA, 63 nt, Human
cugugaacucaggaaugcacaguugacuugggaagcaguauuacuagaucuggaggcaaccac

SEQ ID NO: 2421 - RNA, 62 nt, Human
cugugaagagggagaaucuagccuucagccuguccaguguuaaccacuagagaaacugagcu

SEQ ID NO: 2422 - RNA, 62 nt, Human
cugugaagaugacccaaaguuuccaacuccuuuacaguauuaccgggacuaugaacuaaaag

SEQ ID NO: 2423 - RNA, 63 nt, Human
cugugaagucuucauuuccagaauacugaauuugugugacuuauuuggcucuuaacagagugg

SEQ ID NO: 2424 - RNA, 62 nt, Human
cugugaauaacccaccucuuggcacguaccugcccuaccucacccuguuaagggagcugcua

SEQ ID NO: 2425 - RNA, 62 nt, Human
cugugagccuuuucauuuuguuaauuuuucccaguguuuacaaccaggaaauagcuugucau

SEQ ID NO: 2426 - RNA, 61 nt, Human
cugugauuuuuagaagaacuguuguaaagccuuugagauuagacagacuagagcuacauua

SEQ ID NO: 2427 - RNA, 61 nt, Human
cugugcaauagagauacagcucucuucagaguaacugugaaccuuuuauaaccaacacuag

SEQ ID NO: 2428 - RNA, 62 nt, Human
cugugcauucuggucagucuggaccucagcaacuucaucucaggacuaaagagcuggguccu

SEQ ID NO: 2429 - RNA, 62 nt, Human
cugugcuaccuggguccuuuucagaagugagcuuugcugcuacaggggaagguggccucugu

SEQ ID NO: 2430 - RNA, 62 nt, Human
cuguggaaggguugcagccauuaccuuuuaugcuucaucucaacauuuugcacuguccagua

SEQ ID NO: 2431 - RNA, 62 nt, Human
cuguggccaaucugaaggccuucguuggaaguguuguuuacaguaauccuuaccaagauaac

SEQ ID NO: 2432 - RNA, 62 nt, Human
cuguggccucacccugaagucagcgggcccaggccuaccucacucucucccuuggcagagaa

SEQ ID NO: 2433 - RNA, 63 nt, Human
cugugggacagcugccuucccacgaaaguguaaagcaguauuaagaucauuacugcaugugcc

SEQ ID NO: 2434 - RNA, 61 nt, Human
cugugggcaauuguuacaaguguucuuagguuuacugugaagagaauguauucuguauccg

SEQ ID NO: 2435 - RNA, 62 nt, Human
cugugguuccucaguuucuccugccagccccggcucaucucagggcaaagcuauagacaugg

SEQ ID NO: 2436 - RNA, 63 nt, Human
cuguguaccuugucuaaaacaccgcaucucacucagugacuuauuucucauuaugcuaauugu

SEQ ID NO: 2437 - RNA, 62 nt, Human
cuguguagcuggggauggggauuccuaggggcagaugaaggacaagccccacuggagugggg

SEQ ID NO: 2438 - RNA, 62 nt, Human
cugugugucucuguauuuucuuacauuuggaguauguuuacaagacaauaacacaaaggaaa

SEQ ID NO: 2439 - RNA, 62 nt, Human
cuguguguuucaagaaauucaccaugucagcaauaugaaggauguuauggaaggcgugcuag

SEQ ID NO: 2440 - RNA, 61 nt, Human
cuguguuauuuaugcuuugauuugaaucuggagacugugaaggcaggaguaagugcacagc

SEQ ID NO: 2441 - RNA, 62 nt, Human
cuguguuuaagcacagggcugauaguugugguuuuguuuacaaauguucuguuuuggcugcu

SEQ ID NO: 2442 - RNA, 62 nt, Human
cuguguuuuugccacugauuuagccaugugaaacucaucucauuacccuuuucuggguuuga

SEQ ID NO: 2443 - RNA, 62 nt, Human
cuguuaaauuaagucauuggauuuuacucuguucuguuuacaguuuacuauuuaagguuuua

SEQ ID NO: 2444 - RNA, 63 nt, Human
cuguuaacuuucuuccuuccccucaggcaauggcggugacuuacaaugaaccauaauguccac

SEQ ID NO: 2445 - RNA, 61 nt, Human
cuguuaagccauuagucucuaaauuccagcuuuacugugaaguucuauagaguguuaaaua

SEQ ID NO: 2446 - RNA, 64 nt, Human
cuguuaucauuuuuuccuguuugggaagagcuuagaaacuggaaauacuagauuugggagaagg

SEQ ID NO: 2447 - RNA, 62 nt, Human
cuguucagugcuauucucccagcuagguuuauccaugaaggacugagugaccuuuguuguau

SEQ ID NO: 2448 - RNA, 62 nt, Human
cuguucaucugggcugccuggcagagagccuugcuguuuacaauuaaaauguuucugccgag

SEQ ID NO: 2449 - RNA, 63 nt, Human
cuguugaaauaaacccaacucuucaugauuugccugugacuuauuuuuaaaacuuuuuuaaaa

SEQ ID NO: 2450 - RNA, 61 nt, Human
cuguugagagcauuucagccagaggacuuuggaacugugaauauacuuccugaaggggagg

SEQ ID NO: 2451 - RNA, 62 nt, Human
cuguugagugagcugcuaugacuuugguagagaggugcaauauguuuuuugaaccagcuaua

SEQ ID NO: 2452 - RNA, 62 nt, Human
cuguugauauccacuggaugccaggcaauguggcaugaaggagaagagacaagucaauguug

SEQ ID NO: 2453 - RNA, 62 nt, Human
cuguuggcuacaucauuuuguguugaauaauaaagugcaauacuuuauucuccauaauuaaa

SEQ ID NO: 2454 - RNA, 64 nt, Human
cuguuggugaggaagggaaagguuuuucuuguagggaacuggaaccagcccacaacugcacacu

SEQ ID NO: 2455 - RNA, 62 nt, Human
cuguuguuuuuugaagugccaaucccaugccaugcaguauuaugucccucuccuaucugugu

SEQ ID NO: 2456 - RNA, 61 nt, Human
cuguuuauucugggaaauguuuuaaugccagggccugcugaguugcuucuucuuguggaga

SEQ ID NO: 2457 - RNA, 62 nt, Human
cuguuucuugaauauauauuuuugaaguuuuuuugugcaauauauuacuaaaucaguuauua

SEQ ID NO: 2458 - RNA, 62 nt, Human
cuguuuuccuaaagacagccacucugagaaggagaugaaggaacacggcaggguucaucaau

SEQ ID NO: 2459 - RNA, 61 nt, Human
cuguuuugggggaagucucucccacuuugggauccugcugaagcuagguucaugaggucgg

SEQ ID NO: 2460 - RNA, 61 nt, Human
cuguuuugguuugacaugacaaggaaaggacuuccugcugacccugagagccucuggggug

SEQ ID NO: 2461 - RNA, 63 nt, Human
cuguuuuucucuucaggcucuggaaaaucagaucugugacuuaaucuuccucucccuggcccu

SEQ ID NO: 2462 - RNA, 62 nt, Human
cuguuuuuuuaguucuguauguauuuuagcaaucucaucucaccuaacugagauguguuuca

SEQ ID NO: 2463 - RNA, 62 nt, Human
gccugaugaugugacaaugcauggucuuugugcaugcugcuagacacuuuucuuucccagcc

SEQ ID NO: 2464 - RNA, 63 nt, Human
gccugcacagggcccagggagagauuuguucuugugugacuuagagcuggguguggguacuaa

SEQ ID NO: 2465 - RNA, 62 nt, Human
gccugcaguuacauugaauuguagguguuucgugugcugcuaagguaugcuuauuugaguuu

SEQ ID NO: 2466 - RNA, 62 nt, Human
gccuggcauucaauuugugagguguaaaaccugcaugaaggaccccucuuuuuguggagagc

SEQ ID NO: 2467 - RNA, 61 nt, Human
gccugggaguagauauuguccuagaugcuggagugagauuauauaguaaagaugaugaacc

SEQ ID NO: 2468 - RNA, 61 nt, Human
gccugguuuccuuuguacuaaucgggaaggcugugagauuaauccagagcauuaauuguau

SEQ ID NO: 2469 - RNA, 61 nt, Human
gccuguauuuccagguagacguggacuuuauugacugugaauucauuuacauguaacuucu

SEQ ID NO: 2470 - RNA, 62 nt, Human
gccugugccacgauugcaggagucccugccaucauguuuacagaggacaguauuugugggga

SEQ ID NO: 2471 - RNA, 61 nt, Human
gccuguggugaaguguggcugguguccccuuccccugcugaccuuggaggaaugacaauaa

SEQ ID NO: 2472 - RNA, 61 nt, Human
gccuguguuuuuucaucuuguuuaggaauguuuugagauuaaugugcuuaaaaguccuacg

SEQ ID NO: 2473 - RNA, 59 nt, Human
gccuguuggcggccucuagaauguccagccucuaccucaacagugggcccuccacgccc

SEQ ID NO: 2474 - RNA, 62 nt, Human
gccuuaguccagggggucacuccucccaccccaccuaccucacaggguuguugugagggugc

SEQ ID NO: 2475 - RNA, 62 nt, Human
gccuucccagcaggccaggccgcugggcugggaucaguguuauuuauuugccguuuuaauuu

SEQ ID NO: 2476 - RNA, 61 nt, Human
gccuugaccucccccugcagccugagccuucuuacugugaauuauaacucagggacugugg

SEQ ID NO: 2477 - RNA, 63 nt, Human
gccuugcaaagguaaucucucauuuuaaaauuggacaguauuaaugaaggggaaauauacaau

SEQ ID NO: 2478 - RNA, 62 nt, Human
gccuugcacauaguagacauucaauaaauacuaaaugaaggaauaugcaugcaucuuuguga

SEQ ID NO: 2479 - RNA, 63 nt, Human
gccuugccaguuuuccgaagucucugauuaguugacaguauuaacacuaaauugcaguuuaca

SEQ ID NO: 2480 - RNA, 62 nt, Human
gccuuggcuucugauuauuugcagcugcgauggauguuuacaggaacccagccagaguuugc

SEQ ID NO: 2481 - RNA, 63 nt, Human
gccuuguuucucuuuuauuuuuuauuuuuucgcaucaguauuaauguuuuugcauacuuugca

SEQ ID NO: 2482 - RNA, 62 nt, Human
gccuuuauaauuuagaaagagacugcguugagacaugaaggaucagaaggaauuuccuauuu

SEQ ID NO: 2483 - RNA, 62 nt, Human
gccuuuggucuccuggaugggccuuugagccugauguuuacagugucugugugugugugugc

SEQ ID NO: 2484 - RNA, 62 nt, Human
gccuuugugucuggcauuuguuuaagaaaaugaaaugaaggaaacacugugcaauguuuuuu

SEQ ID NO: 2485 - RNA, 62 nt, Human
gccuuuuguauuuuuauuuuuguucaucugcugcuguuuacauucugggggguuagggggag

SEQ ID NO: 2486 - RNA, 62 nt, Human
gcgagaacugguuaugagacauuggaauacuucuugcugcuacaugucaucuuaauuuugga

SEQ ID NO: 2487 - RNA, 63 nt, Human
gcgaggaaaacccauggcugcuuugugucaccucagugacuuacagucccccuuggcauuuag

SEQ ID NO: 2488 - RNA, 63 nt, Human
gcgagggagaaucaugguucugcagucugguguagacacuggaauaacagcacagaaaaaucu

SEQ ID NO: 2489 - RNA, 61 nt, Human
gcgauccacccccaccucggcuucccaaagugcugagauuacaggugugagccaccgcacc

SEQ ID NO: 2490 - RNA, 64 nt, Human
gcgcaucucuuucuuuguuugucaaaugaaaauuuuaacuggaauugucugauauuuaagagaa

SEQ ID NO: 2491 - RNA, 63 nt, Human
gcgccucgcugugccagacacaguaggcgcucaaucaguauuaguucccaccauuccccuuuu

SEQ ID NO: 2492 - RNA, 62 nt, Human
gcgcugggguuuaugcuuucugaauaaacacuacuguuuacaugcgauggccuggcccugga

SEQ ID NO: 2493 - RNA, 52 nt, Human
gcggaaucauacacucugaaauugaacuggaaucacauauuucacaacaggg

SEQ ID NO: 2494 - RNA, 61 nt, Human
gcggacagaguuuccuuacgaggagacuuggucacugugaaggagaaagagugagggcaau

SEQ ID NO: 2495 - RNA, 61 nt, Human
gcggcucgcaggggcgcucagccccacccugugccugcugaugcccacaggggagccaggc

SEQ ID NO: 2496 - RNA, 61 nt, Human
gcgggaggggccccaguggcugagcuccaagugccugcugaagucugcagggaaacacgcu

SEQ ID NO: 2497 - RNA, 55 nt, Human
gcgggcagacauccugugaaagcaggaccugcugaagaggagacuuucuaugccc

SEQ ID NO: 2498 - RNA, 57 nt, Human
gcgguccaggcagcauuagcccaucgugcccugcugaggggcuggcugccuugagug

SEQ ID NO: 2499 - RNA, 62 nt, Human
gcggugcaguggcaaggggggcuacuuguguggcauaagcuagaggagccggugccgccuga

SEQ ID NO: 2500 - RNA, 62 nt, Human
gcgguguggccagcugugaggagaaagcagcuggcaguguuaggacauuaguccaccuucag

SEQ ID NO: 2501 - RNA, 62 nt, Human
gcgugagcugagcaggccacacuucaaacuacuuugcugcuaauauuuuccuccugagugcu

SEQ ID NO: 2502 - RNA, 61 nt, Human
gcgugucaaaagaaggaacagcucguucugcuuccugcugagucggugaauucuuugcuuu

SEQ ID NO: 2503 - RNA, 64 nt, Human
gcuaaaaaguauauuuauugcagaggauguucauaaggccaguaugauuuauaaaugcaaucuc

SEQ ID NO: 2504 - RNA, 62 nt, Human
gcuaacaagcacuuuaguugcugguuuacauucaaugaaggaggauucauacccauggcauu

SEQ ID NO: 2505 - RNA, 62 nt, Human
gcuaaguagcauggacaaagaacagaggcaucuugugcaauagauaggccucuauccaacug

SEQ ID NO: 2506 - RNA, 62 nt, Human
gcuaaucuaguggggacguggagaacuuuugagucuaccucagggauuauagaugcaccaau

SEQ ID NO: 2507 - RNA, 64 nt, Human
gcuaauuaaaaaaauauagauguuuauuuauuuuuaaugcaguaauauauggagaaaugaacaa

SEQ ID NO: 2508 - RNA, 64 nt, Human
gcuacaaaaaacugcaguuugaucaaauuuggguauaugcaguaugcuacccacagcgucauuu

SEQ ID NO: 2509 - RNA, 63 nt, Human
gcuaccuguggugauguugccaccuguuaaaauguacacuggauauguuguuaaacacguguc

SEQ ID NO: 2510 - RNA, 61 nt, Human
gcuacguaauuauacuuaaaauauccacuggacacugugaaauacacuaacaggauggcug

SEQ ID NO: 2511 - RNA, 62 nt, Human
gcuagaacaacaaacuaucuuauguuuacauacugguuuacaauguuauuuaugugcaaauu

SEQ ID NO: 2512 - RNA, 61 nt, Human
gcuagguuaaacuuuuacuugacaacaaggauuccugcugaagucugaaccuuacugugua

SEQ ID NO: 2513 - RNA, 63 nt, Human
gcuagugacauguacauacuguauauagccggauuaacgguuauaaaguuuuguaccauuuau

SEQ ID NO: 2514 - RNA, 62 nt, Human
gcuauagagaacauucuuccaagauaaauauguguguuuacacauaugucugcaugcaugug

SEQ ID NO: 2515 - RNA, 61 nt, Human
gcuauguaaccccaauugccugcuccauuaaagacugugaagguagaauguuuguaaagcu

SEQ ID NO: 2516 - RNA, 61 nt, Human
gcuauguuugaacaaagaugucgugcaaacuguacugugaacaacaguugguuuaaaauau

SEQ ID NO: 2517 - RNA, 61 nt, Human
gcuauuuagaaagacugaaaccaagacuauuuaacugugaacuauguagcagauguuuuaa

SEQ ID NO: 2518 - RNA, 61 nt, Human
gcucaacaagauacaaucucacucuguggugguccugcugacaaaucaagagcauugcuuu

SEQ ID NO: 2519 - RNA, 62 nt, Human
gcucaaguacuuaaguagucuggcucaaguacuuuguuuacaauuaaaauggauauuauagc

SEQ ID NO: 2520 - RNA, 62 nt, Human
gcucagaaaaaagaugcuaauauauuuaucucauuguuuacauaagcuuuuacaguuucaga

SEQ ID NO: 2521 - RNA, 61 nt, Human
gcucagagguacgagaugcccaaguuugucaguugagauuaaaaguaaggaacagagaaug

SEQ ID NO: 2522 - RNA, 62 nt, Human
gcucagcaucauuucaugccaaagugcugcuaugggcugcuuugugugcacaaaauugcuuu

SEQ ID NO: 2523 - RNA, 61 nt, Human
gcucaucaccucucccuaucccagacuaacuuuacugugaaauccuaccacauuccauguc

SEQ ID NO: 2524 - RNA, 62 nt, Human
gcucauuucacccaaccuggauucuaguccugugugcugcuaccugugugcugcuaggauag

SEQ ID NO: 2525 - RNA, 62 nt, Human
gcuccaaagaagacaauaguucccacucaugauuuuccguuacaaacaggcagcuggggcau

SEQ ID NO: 2526 - RNA, 61 nt, Human
gcuccagggaacggggugucuggccucacugguacugugaaaaaugcucagagagcaagcc

SEQ ID NO: 2527 - RNA, 61 nt, Human
gcucccaagggaggcccaugugacuaauaaaaaacugugaacccuccccgccuuccgcucc

SEQ ID NO: 2528 - RNA, 61 nt, Human
gcucccccaugcgaggauccgggucugccuccuccugcugaagacagacaugcagcagcgg

SEQ ID NO: 2529 - RNA, 61 nt, Human
gcucccugguuucccaagggaaagacuuucuggccugcugaggucgaaucuuccaagaggc

SEQ ID NO: 2530 - RNA, 61 nt, Human
gcuccuccugugugacuggcaagaggccucaugccugcugagagaggggcauugccaagcc

SEQ ID NO: 2531 - RNA, 61 nt, Human
gcuccuggaccaugagcuucacccccagaauucccugcugacccugccccacuuccaggga

SEQ ID NO: 2532 - RNA, 62 nt, Human
gcuccuuggaagaagggauggggggaugagaucauguuuacagaccuguuuugucauccugc

SEQ ID NO: 2533 - RNA, 64 nt, Human
gcucgcugggaccucccuaaacccuuccuggaagaaaacuggaaccaacucugcccuaccuccc

SEQ ID NO: 2534 - RNA, 62 nt, Human
gcucucaaguucacccuuuagggaaaaguuauuuuguuuacauuauuauaagggauuuguga

SEQ ID NO: 2535 - RNA, 61 nt, Human
gcucuccacuuccugauuucugcuuuaaggaaaacugugaacuuucugcuucauguaucag

SEQ ID NO: 2536 - RNA, 64 nt, Human
gcucugaccucagggcucccagcucggggccuguggggccaguaugcuggucugggagucccuc

SEQ ID NO: 2537 - RNA, 62 nt, Human
gcucugcagugcuaugagccuuauaucuguuaauaugaaggacaaagucaaaagcagcagug

SEQ ID NO: 2538 - RNA, 61 nt, Human
gcucugcucagucuucaauuuguuucuguagcuacugugaacccaaucuuaaaggagguuc

SEQ ID NO: 2539 - RNA, 64 nt, Human
gcucugcuggacacccaagaaagccaugggaacgccaacuggaaagguccccuuccccagggga

SEQ ID NO: 2540 - RNA, 64 nt, Human
gcucugcuguucacuggcccuacccgagacuggugaaacuggaagucuucacacuggaguugcu

SEQ ID NO: 2541 - RNA, 61 nt, Human
gcucugugguaagaaaaaaugaacucuuucaauugagauuaaguccauauuuuucaaacau

SEQ ID NO: 2542 - RNA, 62 nt, Human
gcucuuccaagccaggacucugacucccucuuuccuaccucaagagauguuuuugagggcuu

SEQ ID NO: 2543 - RNA, 62 nt, Human
gcucuugguggaggcaggggaacccugagagugcuguuuacagagaaccucagcucccgucu

SEQ ID NO: 2544 - RNA, 64 nt, Human
gcucuuuuguaggacagggagucugaaaagugggauaugcaguagucacccuaaauaacauuga

SEQ ID NO: 2545 - RNA, 64 nt, Human
gcugaaaaagguugguugauagcagcuuggagugcuaacuggaagaucaaaaucaugucucuug

SEQ ID NO: 2546 - RNA, 63 nt, Human
gcugaaggccagcuucacauuucugcugagagaaggugacuuaacgccuuuuccggcccuagc

SEQ ID NO: 2547 - RNA, 61 nt, Human
gcugaaguucaugcacaccucacaccaguuccuccugcugagcagcccuccugccaaggag

SEQ ID NO: 2548 - RNA, 64 nt, Human
gcugagcaccucuaggcccucuaggcuggggaagcaaacuggaacccauggcaauaauaggagg

SEQ ID NO: 2549 - RNA, 62 nt, Human
gcugagcaucaggaccuugccucgaauugucuuccaguauuacggugccucuucucugcccc

SEQ ID NO: 2550 - RNA, 61 nt, Human
gcugagccagguccuagcuguucuccagacccaccugcugacuuuagacucuaagagaggg

SEQ ID NO: 2551 - RNA, 62 nt, Human
gcugaggagacaaccagaucaggagagcaaggucaugaaggaggggaccucuccacacaggu

SEQ ID NO: 2552 - RNA, 62 nt, Human
gcugaguagggacucagggccaugccugccccccucaucucauucaaaccccacccuaguuu

SEQ ID NO: 2553 - RNA, 62 nt, Human
gcugaguuuuuuauuuuuaaguguuuguuuuucagugcaauaauuuuugugugugugugauu

SEQ ID NO: 2554 - RNA, 64 nt, Human
gcugauccaagugaaaaagguagagaaugugcucucaacuggaaaaugccaauuaaggaagcag

SEQ ID NO: 2555 - RNA, 62 nt, Human
gcugcaagcaaggggcuagaaguucaccuccugacaguauuauuaauacuaugcaaauaugg

SEQ ID NO: 2556 - RNA, 62 nt, Human
gcugcaguggguaguucuaaggauggaaaggugacaguauuacucucgagaggcaauucagu

SEQ ID NO: 2557 - RNA, 62 nt, Human
gcugcccaacuccugugagagaaaaaccaaucaauguuuacaaaauggaaaaggacacagca

SEQ ID NO: 2558 - RNA, 61 nt, Human
gcugccgccaccacggcauuaugaucccuucccccugcugaucaaucugcaguuugugaac

SEQ ID NO: 2559 - RNA, 62 nt, Human
gcugcgagacccggcucucagcccugccuugccccuaccucagcgucucuuccaccugcugg

SEQ ID NO: 2560 - RNA, 62 nt, Human
gcugcucccacggaggggagcaggaaugcugcacuguuuacacccugacugugcuuaaaaac

SEQ ID NO: 2561 - RNA, 63 nt, Human
gcugcugagaauaaaugucuuguuaaaaacguggcaacgguuacucuuaggugccauggaucg

SEQ ID NO: 2562 - RNA, 62 nt, Human
gcugcugcucucguacuaacugugccagugcccauguuuacagaagucaggggaaggaagga

SEQ ID NO: 2563 - RNA, 63 nt, Human
gcugcuggaaaucacugcuuucauucccacaaaaccaguauuacuuuuuuuuaaaaaaagaaa

SEQ ID NO: 2564 - RNA, 63 nt, Human
gcugcuggccgaagaugucaccaaggccaaagacacaguauuaugaagguuuggaaaccccuc

SEQ ID NO: 2565 - RNA, 64 nt, Human
gcugcuuggcaccuuagcagacugcuggaaccuuuuggccaguaggucgugcccgccuggugcc

SEQ ID NO: 2566 - RNA, 63 nt, Human
gcuggaccacaacucagcccuucaccugugcaccugugacuuauucuuuacaggaacuggugg

SEQ ID NO: 2567 - RNA, 62 nt, Human
gcuggagugggguacagaguucaguuuuccucucuguuuacagcuccuugacagucccacgc

SEQ ID NO: 2568 - RNA, 62 nt, Human
gcuggcacaugagaucgagcggcugcagauggagaugaaggaggacgacguuucuuuucuca

SEQ ID NO: 2569 - RNA, 62 nt, Human
gcuggcagugcucaccccaggcuucccugaugucuguuuacauaccaaaguuaaaaagcugg

SEQ ID NO: 2570 - RNA, 62 nt, Human
gcuggcauauuuuggaauucugcacauucauggagugcaauaauacuguauagcuuucccca

SEQ ID NO: 2571 - RNA, 61 nt, Human
gcuggcccguugguuuucugagcagggggcugaacugugaacaagucagacaaauaaagca

SEQ ID NO: 2572 - RNA, 61 nt, Human
gcugggaugacaggcgugagcccccgcgcccggccugcugacccguuucuucgaggcacau

SEQ ID NO: 2573 - RNA, 61 nt, Human
gcugggauuacaggcaugagccacugcaccugaccugcugaauuguuuauaauggcaagaa

SEQ ID NO: 2574 - RNA, 63 nt, Human
gcugggcgugguaguacaugccuguaaucccagcuacacuggaggcugagucaggagaaucac

SEQ ID NO: 2575 - RNA, 62 nt, Human
gcuggggcccaagaucaucauugugaagcggaugaugaaggacgucuucuucuuccucuucc

SEQ ID NO: 2576 - RNA, 62 nt, Human
gcuggguuauuuauuuugauuuuagcauuaaaugucaucucaggacaucucuaaaagggguu

SEQ ID NO: 2577 - RNA, 62 nt, Human
gcuggguucuaauaagcccuacuuccaccuaaucuguuuacagucuuuugguauguuucagu

SEQ ID NO: 2578 - RNA, 64 nt, Human
gcugguagaaaaaaagcugguggugaaccaaggucaaacuggaaauuauagucacaguauagau

SEQ ID NO: 2579 - RNA, 62 nt, Human
gcuggucucaaacuccugaccucaggugauccgccuaccucagccucccaaagugcugggau

SEQ ID NO: 2580 - RNA, 64 nt, Human
gcuggugggaccuaaugucaccuuaauucugacuugaacuggaagcauuuuaagaaaucuuguu

SEQ ID NO: 2581 - RNA, 63 nt, Human
gcuguaauaaauaaaaugguaguaaugaaugcaaucaguauuagccaaaauaaagaauuuaug

SEQ ID NO: 2582 - RNA, 62 nt, Human
gcuguauuuuccccccacuucucuauguaacgauauaagcuaucggagggugguaccgauca

SEQ ID NO: 2583 - RNA, 64 nt, Human
gcugucacucacaaaaggcuggaugugcuuucauccaacuggaaggcuuuauucuuccaaguuc

SEQ ID NO: 2584 - RNA, 62 nt, Human
gcugucaugcuuuuucugaauggacaggagaaacauaagcuacggaguauucacuucugagg

SEQ ID NO: 2585 - RNA, 62 nt, Human
gcugucugccgaggagcgccaagaagaugucacuuguuuacacacgaacugccacaucccca

SEQ ID NO: 2586 - RNA, 62 nt, Human
gcuguguauuuaucaaguugguauguuguauguacaguguuauucaugucaucaugagaaug

SEQ ID NO: 2587 - RNA, 62 nt, Human
gcuguguuuuccuaagcugagaucuguugaauaauguuuacauucgucccccggggaaaugu

SEQ ID NO: 2588 - RNA, 62 nt, Human
gcuguuaaguuuguuauuuggguauaaaaccagauguuuacaccuguugacaucauuggugu

SEQ ID NO: 2589 - RNA, 62 nt, Human
gcuguugaaugaaugaauuuauaagaugccuuauuguuuacaaaguacuuuuacaucuuauc

SEQ ID NO: 2590 - RNA, 64 nt, Human
gcuguugcuucgguuauuuaaauaaaaagaaaguggaacuggaacugacaccugacugggaugc

SEQ ID NO: 2591 - RNA, 62 nt, Human
gcuguuuugaauaacauaggugcucuuccucaucucaucuccuacaccguggugagcauaca

SEQ ID NO: 2592 - RNA, 62 nt, Human
gcuuaacugucuucacuauuaauacuauuuagaaauaagcuaauuggaucaguggcuuaaau

SEQ ID NO: 2593 - RNA, 62 nt, Human
gcuuaguuugugcgcaucggcauuugugggagaaaugaaggauuaauacauuuuguuuuaug

SEQ ID NO: 2594 - RNA, 62 nt, Human
gcuucaagaaauccuuuggaaauaaaaaguuaaauguuuacauuucaugugguauuucaggu

SEQ ID NO: 2595 - RNA, 62 nt, Human
gcuucaggaucaauuuuguuggcaagcaguaaaaauaagcuaucuaccuagcgacccguggg

SEQ ID NO: 2596 - RNA, 62 nt, Human
gcuuccccugaagagugaggacccguguaacuggcaguguuacauugaccccagccugacug

SEQ ID NO: 2597 - RNA, 62 nt, Human
gcuuccuuuuuuccuaacauucccagcaaauuuuugcugcuaagacuaucacuguuaaagug

SEQ ID NO: 2598 - RNA, 62 nt, Human
gcuucuuucaacccaguaucaggaagcacuaccccaguguuauuauuuguuuugucaaggua

SEQ ID NO: 2599 - RNA, 62 nt, Human
gcuugaaagcgaugaagaaugucucuagaagagaaugaaggauugaagaauucaccauuaga

SEQ ID NO: 2600 - RNA, 61 nt, Human
gcuugagcccaggagagugaggcugcagugagcugagauuacgccacugcacucuagccug

SEQ ID NO: 2601 - RNA, 62 nt, Human
gcuugaggcucagaagagccucuguccagccccucaguauuaccaugucucccucucagggg

SEQ ID NO: 2602 - RNA, 61 nt, Human
gcuuggaaguuuuugugcccaggagaguaaauaacugugaacaagaggcucugcccuuagg

SEQ ID NO: 2603 - RNA, 62 nt, Human
gcuugguagccccucgaggcagaugcaccugacuugcugcuauuaaaaagccgugugccuuc

SEQ ID NO: 2604 - RNA, 62 nt, Human
gcuugguuaugaguaaaaauuagaauuaugcugccuaccucacagagguaucaugaagauag

SEQ ID NO: 2605 - RNA, 64 nt, Human
gcuugucauuuguaucaauugaccuuuccccaaaucaugcaguauugaguuaugacuuguuaaa

SEQ ID NO: 2606 - RNA, 62 nt, Human
gcuuguuuguugcaggcuguaaggcauggcugcuuguuuacaaagcaucucauucauauuac

SEQ ID NO: 2607 - RNA, 62 nt, Human
gcuuuaaagagcgaaaugagugugucauuuccacaugaaggagaggcaaggaaaagccccac

SEQ ID NO: 2608 - RNA, 64 nt, Human
gcuuuaauuuuguuugcacuccuauuuugagcuuguaacuggaaaagcaugucuugcacuguuc

SEQ ID NO: 2609 - RNA, 62 nt, Human
gcuuuauaaauggacaggcauggggaauaagaaucaguguuaauuuaaaugaucuuauccug

SEQ ID NO: 2610 - RNA, 62 nt, Human
gcuuucuggguaauucaccaauuuccuuuaaaacauaagcuaccugaauggagaauacaucu

SEQ ID NO: 2611 - RNA, 61 nt, Human
gcuuucuuggucagugccugucaaggcuccaguccugcugagccaaaggcuuugucauucc

SEQ ID NO: 2612 - RNA, 61 nt, Human
gcuuugaauaauaauuuuucccuuuguacaugaccugcugaauuucgguacaguguuuuug

SEQ ID NO: 2613 - RNA, 64 nt, Human
gcuuuggucuaacuucuacauuccuacuguuaaaaaggccaguauaucuuaaacaaaugaauag

SEQ ID NO: 2614 - RNA, 62 nt, Human
gcuuuguuuugugguaguccuuuugggaagaauccaguauuauccacaauuauuggcaaagu

SEQ ID NO: 2615 - RNA, 62 nt, Human
gcuuuuagcaguuggcuggaauguguucacuagguuccguuauguuugguaauaucaucuug

SEQ ID NO: 2616 - RNA, 62 nt, Human
gcuuuuaguuuguucuuaaaccaguuuuguuaaauguuuacaaggaccucaguacuaaagcc

SEQ ID NO: 2617 - RNA, 61 nt, Human
gcuuuuauauauuaaaaaacguaucaugcaccaacugugaauagcugccgcuugcgcagag

SEQ ID NO: 2618 - RNA, 63 nt, Human
gcuuuuggagagaauguugauuggcaaaagcagcacaguauuaauauuuagaguaggaugcag

SEQ ID NO: 2619 - RNA, 62 nt, Human
gcuuuugucauuguugccaucauauggaagauaauguuuacauccuuuuaaacauuuuuaua

SEQ ID NO: 2620 - RNA, 64 nt, Human
gcuuuuguucuuaguuuuugccguuagaucccuucaaacuggaaguuccuuacaauaucuuucu

SEQ ID NO: 2621 - RNA, 62 nt, Human
gcuuuuuacuuugcuagaacaacaaacuaucuuauguuuacauacugguuuacaauguuauu

SEQ ID NO: 2622 - RNA, 64 nt, Human
ggaaaaaacccagagagcaaagugcauuacuuaaagaugcaguauauacuuuucucauuuuuaa

SEQ ID NO: 2623 - RNA, 61 nt, Human
ggaaaaaauuaaaaagaaaaacugguuccauguacugugaacuugaaaacuugcagacuca

SEQ ID NO: 2624 - RNA, 62 nt, Human
ggaaaacccauuaguagaguucaagcuucaguauucaucucaaagagaaaccuugggaacau

SEQ ID NO: 2625 - RNA, 62 nt, Human
ggaaaacuugcagaaaugugauuuuucccagauuuguuuacauguucccugggacagaucca

SEQ ID NO: 2626 - RNA, 62 nt, Human
ggaaaaguaaaauccaaaauguuagcaaaacaaagugcaauauuaaauguuugcuuuauaga

SEQ ID NO: 2627 - RNA, 62 nt, Human
ggaaaauacuuuuugaaauuuaucaccauuuuaguguuuacauuucaauaaauaguucacuu

SEQ ID NO: 2628 - RNA, 62 nt, Human
ggaaaauguacuaccuagaaaauggccagauuuucaguguuaacgugugggaggaauuuuuu

SEQ ID NO: 2629 - RNA, 62 nt, Human
ggaaacaccagggguuccaucuaggucuugcugcucaucucacagaaagccagucacugaga

SEQ ID NO: 2630 - RNA, 64 nt, Human
ggaaacagaaaauguguguauuuaaagacgaugccuaugcaguauauuguuugggauagauugc

SEQ ID NO: 2631 - RNA, 62 nt, Human
ggaaaccaauuuuuuuaguuauuguucaaggagggugcaauauuaaguguuuuggaauuuga

SEQ ID NO: 2632 - RNA, 62 nt, Human
ggaaacgaacccacugugcuuacagugacugucguguuuacaaaaggcagcccuuuggguac

SEQ ID NO: 2633 - RNA, 62 nt, Human
ggaaagaaauaccauauacauagauggaaaaacccaguauuauaaaaaccucaauucugaaa

SEQ ID NO: 2634 - RNA, 64 nt, Human
ggaaagacuuaauuuccuuguugagaacaggaaaguggccaguagccaggcaagucauagaauu

SEQ ID NO: 2635 - RNA, 64 nt, Human
ggaaagaugaaaaaaagagguagcuuuuagauugcaaacuggaaauguaaaacucaugaaauuu

SEQ ID NO: 2636 - RNA, 61 nt, Human
ggaaagcccauuagccuagggcuaauugugacugugacuuacuucucccucuuggagaaag

SEQ ID NO: 2637 - RNA, 61 nt, Human
ggaaagcuaauucccggguggacgcugaacauaccugcugagagacucuguccccugguuu

SEQ ID NO: 2638 - RNA, 61 nt, Human
ggaaaggagggaaggcaagauucuuucccccucccugcugaagcaugugguacagaggcaa

SEQ ID NO: 2639 - RNA, 62 nt, Human
ggaaagucgauguaauuaacugauggcccaaaaacuaccucaagagaccuggcccuguuaag

SEQ ID NO: 2640 - RNA, 62 nt, Human
ggaaaguuuuugugagcuguguaaucccucuggucaguauuaugaaaucauuugucaguggu

SEQ ID NO: 2641 - RNA, 62 nt, Human
ggaaaugaguaaaucacuguucagcaacacugauuuccguuaacacaucaguuaugaauuuc

SEQ ID NO: 2642 - RNA, 62 nt, Human
ggaaauugguugacuauuaguuuuuaacuaaaaugugcaauaacacauugcaguuuccucaa

SEQ ID NO: 2643 - RNA, 62 nt, Human
ggaacacuuuccucuucuaugaccccucucuccccaguauuaucuuacuugcaaaauggaga

SEQ ID NO: 2644 - RNA, 64 nt, Human
ggaacauugauuguaaggccagugaaguuuucacccaacuggaauuugauggaaagaagguuug

SEQ ID NO: 2645 - RNA, 61 nt, Human
ggaacccaaugcucugucucuggacccaggcugccugcugaagucugaaguggggucuggc

SEQ ID NO: 2646 - RNA, 62 nt, Human
ggaacguggauauugugauauggagcuuggagagauaagcuacugacucaaaucgugagcca

SEQ ID NO: 2647 - RNA, 62 nt, Human
ggaacuaauuucuucuccuggaguugcauugauucaguauuacaaauauauagcacaucacc

SEQ ID NO: 2648 - RNA, 62 nt, Human
ggaacucccaguuugacuuucugcgcuucgaccacuaccucaaccccuacuauaaguucauc

SEQ ID NO: 2649 - RNA, 62 nt, Human
ggaacuccuguccccuuagucaugagaacagaaagugcaauauuuccuuucaccuggcaggg

SEQ ID NO: 2650 - RNA, 62 nt, Human
ggaacugaccauuauaugccuucacuggcuucuugugcaauaauaugauguuuuaagugugc

SEQ ID NO: 2651 - RNA, 62 nt, Human
ggaacuuuagaugugacacuguaaaauuauguauucaucucauggcauaaauuauuuaguaa

SEQ ID NO: 2652 - RNA, 63 nt, Human
ggaagaacuuagacaaugccugaaaugcaaaggcgacacuggagucuucuuucucuaacgugu

SEQ ID NO: 2653 - RNA, 62 nt, Human
ggaagaagacuguuuccaaauaauuugaacagcuugcugcuaaaugggacccaauuuuuggc

SEQ ID NO: 2654 - RNA, 61 nt, Human
ggaagaagccugugucgaggcagcuucccuuugccugcugauauucugcaggacugggcac

SEQ ID NO: 2655 - RNA, 64 nt, Human
ggaagaaggaggguagaaccuuaaaaagagaccuugaacuggaaagggucucuugucagggcuu

SEQ ID NO: 2656 - RNA, 62 nt, Human
ggaagaaguucacucagaccuuccugaauucagaucaucucagaagucuggagggaaaucug

SEQ ID NO: 2657 - RNA, 62 nt, Human
ggaagagccagccuugccuuuucuuauaugauuuuguuuacaaaauuuuacugggacuuuua

SEQ ID NO: 2658 - RNA, 61 nt, Human
ggaagaugugagagggagcaagcaagguuagcaacugugaacagagaggucgggauuugcc

SEQ ID NO: 2659 - RNA, 62 nt, Human
ggaagauugauuuucuccaucaguucaccuugugucaucucauaaugguuggucuuuccagg

SEQ ID NO: 2660 - RNA, 64 nt, Human
ggaagcagaguucagcuaaagggaaucaguaacucuaacuggaacagcuuucuuguagaagugu

SEQ ID NO: 2661 - RNA, 62 nt, Human
ggaagccuucucugccagcgaucucgcagcacuguguuuacaggggggaggggagggguucg

SEQ ID NO: 2662 - RNA, 62 nt, Human
ggaagcuaaaugguggacuugacaacuauucacccuaccucagaucauagaguuuguaaagu

SEQ ID NO: 2663 - RNA, 63 nt, Human
ggaagcuucuacgcgcuagagaggaucaaggggccacacuggaccaugugaacagccauccug

SEQ ID NO: 2664 - RNA, 62 nt, Human
ggaaggcugacuaaccucgauucuguguugugaugugcaauacuguuucuaauguuuguaua

SEQ ID NO: 2665 - RNA, 62 nt, Human
ggaagggacacacaagaagaagggcacccuaguucuaccucaggcagcucaagcagcgaccg

SEQ ID NO: 2666 - RNA, 62 nt, Human
ggaagggagaccacugugucaccuggaggagaagucaucucaugacaacagaagggaggugg

SEQ ID NO: 2667 - RNA, 62 nt, Human
ggaagggcguggcaggggcucugcaugcccgugacaguguuaggugucagcgcgugcuacag

SEQ ID NO: 2668 - RNA, 60 nt, Human
ggaaguacaacuggaauaaaacaaaaacccuaacacuggaaguguaaacaugucuauuga

SEQ ID NO: 2669 - RNA, 62 nt, Human
ggaagucaugaaguuuuuuugcauuuuuauuuaaaugaaggaauuccaaauaacucaccuac

SEQ ID NO: 2670 - RNA, 64 nt, Human
ggaaguggcuugucacaucccacagugaacucagucaacuggaaugccuaacucucuuucauaa

SEQ ID NO: 2671 - RNA, 63 nt, Human
ggaaguucuucaguuuuuaagugaggauaucgugacaguauuaaaacaucgcaauaauguucc

SEQ ID NO: 2672 - RNA, 61 nt, Human
ggaaguugacuaaacuugaaaaauguuuuuaaaacugugaauaaauggaagcuacuuuggg

SEQ ID NO: 2673 - RNA, 62 nt, Human
ggaaguuuaaaacccaaacuuccaaagguuuaaacuaccucaaaacacuuucccaugagugu

SEQ ID NO: 2674 - RNA, 62 nt, Human
ggaaguuucuuccaggaagcaagaccagcugguauguuuacaccugcacuccagugcccugg

SEQ ID NO: 2675 - RNA, 62 nt, Human
ggaauaaagagggcgagguaaaguuuauggaacucaguguuaggaacuuuggcaucuguagc

SEQ ID NO: 2676 - RNA, 62 nt, Human
ggaauaaaggcaccuaagcuauugcuaauugaauugcugcuagaauuagaaauuaugcuuua

SEQ ID NO: 2677 - RNA, 62 nt, Human
ggaauaaauuaaaaacaguauuugggggagaaacgugcaauagcguaaugguggugucccug

SEQ ID NO: 2678 - RNA, 64 nt, Human
ggaauaauguuuugcuacagaaaaucuucauagaagaacuggaaggcuauauaagaaagggaau

SEQ ID NO: 2679 - RNA, 61 nt, Human
ggaauaauuaugucuaacuuuuuacguguuuguugagauuauacuguggucuuucuuucug

SEQ ID NO: 2680 - RNA, 62 nt, Human
ggaauacaaucaaggguuuuguauucagaauguugugcaauauuuuggaaugggacauuggu

SEQ ID NO: 2681 - RNA, 64 nt, Human
ggaauagugaaaacauuuagggacacccaaagaaugaugcaguauuaaaggggugguagaagcu

SEQ ID NO: 2682 - RNA, 62 nt, Human
ggaauaguuuaacagucaggaaggcuaaacuggucaguauuaauguguagcccuaccaaaaa

SEQ ID NO: 2683 - RNA, 61 nt, Human
ggaauauauuuggagcacacccuaguaaccucuugagauuaaauuacauagucuuaauauu

SEQ ID NO: 2684 - RNA, 61 nt, Human
ggaaucaaggauagggcuaagguuuucaccuuaacugugaaggcaggaggaauaggugacu

SEQ ID NO: 2685 - RNA, 62 nt, Human
ggaaucuucgaaauauguacacagagaaaaucacaugaaggagaccugggguccccacuugu

SEQ ID NO: 2686 - RNA, 61 nt, Human
ggaaugacuucugcaacuguagucccagcaggaacugugaagaccagcugcccugcaggau

SEQ ID NO: 2687 - RNA, 62 nt, Human
ggaaugccaccuuauucuggcuacuccugcagaaaugaaggagugggguuauuuuaguauau

SEQ ID NO: 2688 - RNA, 62 nt, Human
ggaaugcuccaguuugaucucccuucugccaccccuaccucaccccuagucacucauaucgg

SEQ ID NO: 2689 - RNA, 63 nt, Human
ggaauuauaaacaagugggaacuuacucuccaguugugacuuaacaguucugaacauaccuac

SEQ ID NO: 2690 - RNA, 62 nt, Human
ggaauucaagguugguucaacaucuaaaaaucaaauaagcuaauauacagucaguucucauu

SEQ ID NO: 2691 - RNA, 62 nt, Human
ggaauucaagguuuguucaacaucuaaaaaucaaauaagcuaauaaagaaaagagguuuaua

SEQ ID NO: 2692 - RNA, 61 nt, Human
ggaauugggaccugguuauguuguuauucucggacugugaauuuuggugauguaaaacaga

SEQ ID NO: 2693 - RNA, 63 nt, Human
ggaauuuugcaagcugauuguuaauuaaguacagucaguauuaaaaaugauauacauuuacaa

SEQ ID NO: 2694 - RNA, 62 nt, Human
ggacaacgcgguccucaggaaccuucaaaccucuaugaaggaacucacaaaaaaacacuggg

SEQ ID NO: 2695 - RNA, 63 nt, Human
ggacagcuguacacugaagagucaucagagaguucacacuggagaaagaccuuuugaaugcag

SEQ ID NO: 2696 - RNA, 61 nt, Human
ggacaggcccacguggaggcugggcaggaagggccugcugaggucacacagcuguuggugg

SEQ ID NO: 2697 - RNA, 63 nt, Human
ggacaugcacacacacucacaugcucucacucaccacacuggagggcacacacguaccccgca

SEQ ID NO: 2698 - RNA, 64 nt, Human
ggaccacggguguuguaagcugggacacggaagccaaacuggaaucaaacgccgacuguaaauu

SEQ ID NO: 2699 - RNA, 62 nt, Human
ggacccagugauaaaaacuuccuuuuagggaucaaugaaggagagaaggucuuggaaucacc

SEQ ID NO: 2700 - RNA, 61 nt, Human
ggaccccccuccaccccccuuccgugccccccaacugugaaucuguaaauaaggcccaagg

SEQ ID NO: 2701 - RNA, 62 nt, Human
ggacgcuucuagggggcucuggcugcccguguuaaugaaggacagcgcuuccgcgagcaccc

SEQ ID NO: 2702 - RNA, 56 nt, Human
ggacggaauuuuauucugaaauucucuuucaucucauuuuggcguugcaucuauug

SEQ ID NO: 2703 - RNA, 63 nt, Human
ggacuaaguaugucuuguucaaaauuguauauucagugacuuacacuaugccuagcacacaac

SEQ ID NO: 2704 - RNA, 63 nt, Human
ggacuacaggaagggcagagaauacugacgguuaccaguauuaacccuucaucuguucuugaa

SEQ ID NO: 2705 - RNA, 62 nt, Human
ggacuaugaucugauggccucuagguguuguuuugugcaauauacagccccagguagggagg

SEQ ID NO: 2706 - RNA, 62 nt, Human
ggacucagaaacgagaucgggaagcagaaauauagugcaauagugcaacaucucugaauccu

SEQ ID NO: 2707 - RNA, 62 nt, Human
ggacugugccaucugugggaaaucccagggcaaauguuuacauuuuguauacccugaagaac

SEQ ID NO: 2708 - RNA, 63 nt, Human
ggacuugccaaacagucuuuuaugaaggaaaguuacaguauuaauuuuugaaaagguuuuuuu

SEQ ID NO: 2709 - RNA, 61 nt, Human
ggacuuugguucucuccaggaagguagcccagcacugugaagacccagcaggaagccaggc

SEQ ID NO: 2710 - RNA, 62 nt, Human
ggagaaaaaugugaauuauuuauccagaugcaugucaucucaaggacaaagccugugaaagu

SEQ ID NO: 2711 - RNA, 63 nt, Human
ggagaaacuggagaaaucacccuuuuaaggaagaaacacuggaaauuucugcuaacaccaaga

SEQ ID NO: 2712 - RNA, 62 nt, Human
ggagaacuguacugcugccucuuucccaccugccucaucucaauccuugagcggcaaguuug

SEQ ID NO: 2713 - RNA, 64 nt, Human
ggagaccaaacuguuccuugcggucuaguauuuaagaacuggaacuugaaaguccuccuucuac

SEQ ID NO: 2714 - RNA, 62 nt, Human
ggagaccccuggugcugggucccugcugcuuucucuaccucaaggggcuuggcagggguccc

SEQ ID NO: 2715 - RNA, 62 nt, Human
ggagacccuguuuuuuuaaaaaaagaaguggagguguuuacaccagcaaaauacucauuuuu

SEQ ID NO: 2716 - RNA, 61 nt, Human
ggagacuguggaggcaguggagacugacuucuuccugcugacagcuggaugucacacauga

SEQ ID NO: 2717 - RNA, 62 nt, Human
ggagaggaaaaucuauuggcucucgugggucucuucaucucagaaaugccaaucaggucaag

SEQ ID NO: 2718 - RNA, 63 nt, Human
ggagaggaaagaacacuucccaacuuacucuaggucaguauuacccugauacuagacuagaca

SEQ ID NO: 2719 - RNA, 61 nt, Human
ggagagggaagaaaaucucaguauuuugaaaauugagauuacuucagagccuuagccacac

SEQ ID NO: 2720 - RNA, 61 nt, Human
ggagagggguggaggcugccccauugagaucuuccugcugaguccuuuccaggggccaauu

SEQ ID NO: 2721 - RNA, 62 nt, Human
ggagagugacucuguuggcagaaggcaggcgaggauaagcuaacgaugcugcuguggccucu

SEQ ID NO: 2722 - RNA, 61 nt, Human
ggagauacaauaucacaccccuuccccacaaggacugugaauauugggauuuauguccuug

SEQ ID NO: 2723 - RNA, 62 nt, Human
ggagcaaugcuggucagcgcugcccagacuccaguguuuacagaucaccagcauuuacaacc

SEQ ID NO: 2724 - RNA, 62 nt, Human
ggagcagaaaaaaaaaaagaacaaccugccacauugcugcuaucaggccguuaguccuagug

SEQ ID NO: 2725 - RNA, 63 nt, Human
ggagccacuguggcaucugaggaagacccaggguacaguauuagcauuucuuucaacccuaag

SEQ ID NO: 2726 - RNA, 61 nt, Human
ggagcccucgcugcgaaaggugguguggcgguaccugcugaacguguauccagauggacug

SEQ ID NO: 2727 - RNA, 63 nt, Human
ggagccguuugugaauaaacuguucuucaucauugacacuggagaaagguguccuccaugccc

SEQ ID NO: 2728 - RNA, 64 nt, Human
ggagccuggagccacuuuaaguuguacuucugacuaaacuggaauuaugagugaggaagagugu

SEQ ID NO: 2729 - RNA, 61 nt, Human
ggagcugccucuuagacucgucuggcccaucuaccugcugacagagcaugacaaagaugac

SEQ ID NO: 2730 - RNA, 64 nt, Human
ggagcuuggugcaauuagaagcaaaagacuguaccuaacuggaaugagguuacuuuuuauggcu

SEQ ID NO: 2731 - RNA, 63 nt, Human
ggaggaaaagcucaagguuagcugucuuaacccaagugacuuaccaggccuacaaaagagucc

SEQ ID NO: 2732 - RNA, 64 nt, Human
ggaggaaccaugcaaaucgccuuccaugguuuuuaaaugcaguaaauaacauuucuggaugaga

SEQ ID NO: 2733 - RNA, 63 nt, Human
ggaggaagagagaacucgcuccucaaccaccccagacacuggagugucaggaaagcacugagc

SEQ ID NO: 2734 - RNA, 62 nt, Human
ggaggaccacgaggaaauacccucaaaacuaacuuguuuacaacaaaauaaaguauucacua

SEQ ID NO: 2735 - RNA, 64 nt, Human
ggaggagaguccuucucggcagagcucacugcaaacaacuggaauugagguugcacacugugau

SEQ ID NO: 2736 - RNA, 64 nt, Human
ggaggaugaagucaauaaaguuuaugccaguuuaaaaacuggaaggaaaagguaagagcucucc

SEQ ID NO: 2737 - RNA, 62 nt, Human
ggaggauguucuuagucugucucaaagcucuauauguuuacauauuauuucuguagauuguu

SEQ ID NO: 2738 - RNA, 61 nt, Human
ggaggcgcccaccccggacccccaccccuccgcacugugaaagacuaacuccugcaacugg

SEQ ID NO: 2739 - RNA, 62 nt, Human
ggaggcuggcuuguccccuccucacucccuucccauaagcuauagacccgaggaaacucaga

SEQ ID NO: 2740 - RNA, 64 nt, Human
ggagggacuauuggaugcucuuuggacuucugaccuaugcaguauucaacaucauuggaugaaa

SEQ ID NO: 2741 - RNA, 63 nt, Human
ggagggagagaucuaaucccuucaaggaagugauaacacuggagugguaacaagaggagcagg

SEQ ID NO: 2742 - RNA, 61 nt, Human
ggagggcagguccagcucugugggcccuacccuccugcugagcugccccugcugcuuaagu

SEQ ID NO: 2743 - RNA, 64 nt, Human
ggagggcauggaagauccagcggaaaguugaaaauaaacuggaaugaucaucuuggcuugggcc

SEQ ID NO: 2744 - RNA, 62 nt, Human
ggagggcucagccuugcugagacacuuucuuuuguguuuacaucaugccaggggcuucauuc

SEQ ID NO: 2745 - RNA, 62 nt, Human
ggagggucauaggacuucgcuaaaauucugauacuguuuacaaagaaaaccggauuuucagu

SEQ ID NO: 2746 - RNA, 61 nt, Human
ggaggucagcacaagauaacgggucauaaagaaccugcugauaaaacagguugcaguaaag

SEQ ID NO: 2747 - RNA, 62 nt, Human
ggagguguagcuccuacuuuugcacaggcaccagcuaccucagggacauggcacgggcaccu

SEQ ID NO: 2748 - RNA, 64 nt, Human
ggagguuugagguccaaauuccugggacucaaauguaugcaguacuauucagaaugauauacac

SEQ ID NO: 2749 - RNA, 62 nt, Human
ggaguacaaggcaugcauguugggaaaggagggaauaagcuagucucugcaggaggcuucag

SEQ ID NO: 2750 - RNA, 61 nt, Human
ggaguagagcagacuauguugagcuaacacagaccugcugaaucagcuucuuucugagcug

SEQ ID NO: 2751 - RNA, 64 nt, Human
ggaguaucaggcuggccgagagucacccauguucucaacuggaaguuggucgccugccccacuc

SEQ ID NO: 2752 - RNA, 62 nt, Human
ggagucagagucucgcucucuuguccaggcuggagugcaauagcgcgaucugggcucacugc

SEQ ID NO: 2753 - RNA, 63 nt, Human
ggaguucgaagggaggaagguagacuucuuucuggacacuggagccaggcuucuguuuuccuc

SEQ ID NO: 2754 - RNA, 61 nt, Human
ggaguugguacagucagccuuugggaagaauccacugugaacaaagcuuaacacauggggc

SEQ ID NO: 2755 - RNA, 61 nt, Human
ggauaaaaucauugccuuguguuacagauucagccugcugaagaguauuccacuuucugug

SEQ ID NO: 2756 - RNA, 63 nt, Human
ggauaaguguuuguguucagaagauguuguuuugccaguauuagaaaauacugugagccgggc

SEQ ID NO: 2757 - RNA, 62 nt, Human
ggauaauuagcaugggaugagcucugggcaugccaugaaggaaagccacgcucccuucagaa

SEQ ID NO: 2758 - RNA, 62 nt, Human
ggauacuguuugaaaugugccaaauuuucuuaccucaucucacagauucacccacaguuuaa

SEQ ID NO: 2759 - RNA, 64 nt, Human
ggauauauaauuuauucuguugaaaaaaaaaaaagcaugcaguaucuaugaccuaucugcagaa

SEQ ID NO: 2760 - RNA, 61 nt, Human
ggaucaauaagcaugucagacugauuaaugucuacugugaaaauuugguaguaaauuuuca

SEQ ID NO: 2761 - RNA, 63 nt, Human
ggaucacauuagagauauuuagaacauauuacccugugacuuacguaggaaaccuaauaugcu

SEQ ID NO: 2762 - RNA, 64 nt, Human
ggaucaggauccaggggagggagauggaggcacccaaacuggaacuucauuugucuuaccuugg

SEQ ID NO: 2763 - RNA, 61 nt, Human
ggauccauguucauucccacuucacaccuugguccugcugauuagagagcucaucagaggg

SEQ ID NO: 2764 - RNA, 62 nt, Human
ggaucccucccccccaugcacugugaaggacccuuguuuacacauacccucuucauggaugg

SEQ ID NO: 2765 - RNA, 55 nt, Human
ggauccugaggaaaacuaaaaguauauacugugaaaacuuugagaagauaauaca

SEQ ID NO: 2766 - RNA, 64 nt, Human
ggaucuacagaaaaaauuuuuuuuuuucaaucuaaaaacuggaaauucuaggguuuuuguacau

SEQ ID NO: 2767 - RNA, 62 nt, Human
ggaucuagauggucugauccuagugaucuaccauaugaaggacauaguuuguguccuggucc

SEQ ID NO: 2768 - RNA, 62 nt, Human
ggaucucaaucuucggggugugaugaauagcgaaucaucucaaauccuugagcacucagucu

SEQ ID NO: 2769 - RNA, 64 nt, Human
ggaucugaacauacagagcccacauuuccacaccagaacuggaacuacguagcuaguaagcauu

SEQ ID NO: 2770 - RNA, 63 nt, Human
ggaugaacuggugcagugccugacagaauaaagaacaguauuaaucccuuugagaaagcauag

SEQ ID NO: 2771 - RNA, 62 nt, Human
ggaugaaucugaacaucucuccaucuagagcccaaugaaggaagcuucaaaugagaacauga

SEQ ID NO: 2772 - RNA, 63 nt, Human
ggaugauucagucuguaccagacaugacaacacacacacuggaaugaaaugugcaaacauggg

SEQ ID NO: 2773 - RNA, 63 nt, Human
ggaugcauuucuaaauucugcaaauguuuccuggggugacuuaacaaggaauaaucccacaau

SEQ ID NO: 2774 - RNA, 62 nt, Human
ggaugccuuuucuaccccaucccucacagccucuugcugcuaaaauagauguuucauuuuuc

SEQ ID NO: 2775 - RNA, 63 nt, Human
ggauggaaacauuacauguaaugcagauauagugaacacuggaaagauuuauuaaagaauuau

SEQ ID NO: 2776 - RNA, 62 nt, Human
ggauuacagggguaagccaccgugccuggccagcauaagcuauuuuuauccucaucuauacu

SEQ ID NO: 2777 - RNA, 63 nt, Human
ggauucacuuuguguguguuagugcucuaaaguagcaguauuauuauuaaacuguccccagag

SEQ ID NO: 2778 - RNA, 62 nt, Human
ggauucaugaugaugccuguugaucuuagggacacuaccucaccugccaguaucuuuggggc

SEQ ID NO: 2779 - RNA, 62 nt, Human
ggauuuauuaagggaugcaaaucuuguugaguuaaugaaggaauuaguaggguuguggcuuc

SEQ ID NO: 2780 - RNA, 62 nt, Human
ggauuuuguuuuuauuuugaaaugggagcuuuuuuguuuacaaguucauuaaaaacuaaaaa

SEQ ID NO: 2781 - RNA, 62 nt, Human
ggauuuuuaaaggaagauuauuuauuuucagauuugcugcuauaauugaaaaccuaguaacu

SEQ ID NO: 2782 - RNA, 62 nt, Human
ggcaaagaggcggacagugcagggcuccucccuccuaccucaggccugauccaucgugcccu

SEQ ID NO: 2783 - RNA, 61 nt, Human
ggcaaauagggucccaggguccagggaggggcgccugcugagcacuuccgccccucacccu

SEQ ID NO: 2784 - RNA, 62 nt, Human
ggcaaguaccaggaugaaaagaacuaugaaauaaaugaaggaagcuacaaguguguguguau

SEQ ID NO: 2785 - RNA, 62 nt, Human
ggcaagugagagcaucugcaaaaugcaaagagaacuaccucauaugcaggaugagccaaugg

SEQ ID NO: 2786 - RNA, 63 nt, Human
ggcacagucagugcuguguuugagguaaaugcaguaacgguuaguuuucuacuuugucuuaua

SEQ ID NO: 2787 - RNA, 61 nt, Human
ggcacaguguaauccagggguguagaugggggaacugugaauacuugaacucuguuccccc

SEQ ID NO: 2788 - RNA, 61 nt, Human
ggcacauacaaaacuuaugaauuacccagcacaacugugaaacucuguauugcuucuuccg

SEQ ID NO: 2789 - RNA, 61 nt, Human
ggcacgccagccagagccuguggagagacuccgccugcugacacuaaacguccugggaagu

SEQ ID NO: 2790 - RNA, 63 nt, Human
ggcacuagacuuuucuauuggccugugccaucgcccaguauuagcacaaguuagggaggaaga

SEQ ID NO: 2791 - RNA, 61 nt, Human
ggcagaaaccacuuacggcugaugaugcgcaacccugcugacuguuucaguuaauaugcug

SEQ ID NO: 2792 - RNA, 61 nt, Human
ggcagagagacuggacagcucuggaggaacaggccugcugaggggaggggagcauggacuu

SEQ ID NO: 2793 - RNA, 61 nt, Human
ggcagagucccagcacggcagcccgccucucccccugcugagacuuuaaucuccaccagcc

SEQ ID NO: 2794 - RNA, 61 nt, Human
ggcagaucgcuaccccaggcugagauggcccccacugugaaggccacgccugugggugggc

SEQ ID NO: 2795 - RNA, 63 nt, Human
ggcagcaagccucucacuuguuguaggacugcaagacacuggaccgaaagccuccaacacaaa

SEQ ID NO: 2796 - RNA, 61 nt, Human
ggcagcagagaaggcccagcugacaggggggauccugcugaaugcuauccuugcaaacuuc

SEQ ID NO: 2797 - RNA, 61 nt, Human
ggcagccaggcaccugucaggcuugggcaggggccugcugagaaucugugaaugcagaggg

SEQ ID NO: 2798 - RNA, 61 nt, Human
ggcagcugacaacgcagacacgcucuacggaggccugcugauaaagggcucagccuugccg

SEQ ID NO: 2799 - RNA, 62 nt, Human
ggcaggcccgcacauauccacuugcuggagcccauguuuacagacagggacauacaccaugc

SEQ ID NO: 2800 - RNA, 61 nt, Human
ggcaggugcacugacacccccaccuucccauccccugcugaaccaggcccuguuacacaca

SEQ ID NO: 2801 - RNA, 61 nt, Human
ggcagguggagggccugcccuggacacaggggcccugcugagcaguggccccauccuggaa

SEQ ID NO: 2802 - RNA, 63 nt, Human
ggcauaagcuaucaccuagcagccucaaaacgggucaguauuaagguuuucaaccggaaggag

SEQ ID NO: 2803 - RNA, 61 nt, Human
ggcauagccagauuccuggcagcugcccagaacccugcugaugagcccacuccaggggccc

SEQ ID NO: 2804 - RNA, 59 nt, Human
ggcauaucuaauaagauagcccuuacuguaagugcaauaguugacuuuuaaccaaccac

SEQ ID NO: 2805 - RNA, 63 nt, Human
ggcauccgcugggggcgcuguucuuuagcuagugccaguauuaaaacauugucauuacgagag

SEQ ID NO: 2806 - RNA, 62 nt, Human
ggcauggugcccucagccuuugcauauacucucucaguauuaacucccaguaaauaauaacc

SEQ ID NO: 2807 - RNA, 64 nt, Human
ggcauuaguacuuugugcucauaaauuggccucuguaugcaguacuaaaauuaaugcagauuuc

SEQ ID NO: 2808 - RNA, 62 nt, Human
ggccaaaugaacguuugcagagcagugggcacaauguuuacaauguauguguaugucacuuu

SEQ ID NO: 2809 - RNA, 49 nt, Human
ggccaacuucaauacauaguuccugcugaccuugcccucugcccacagc

SEQ ID NO: 2810 - RNA, 64 nt, Human
ggccacagaauuagcccaaaauuaucaaagaacauuaacuggaaggucagguuuuucaaggaac

SEQ ID NO: 2811 - RNA, 62 nt, Human
ggccacccucacucauguacucauuccugguggcucaucucaggacagaaggcaauugcagc

SEQ ID NO: 2812 - RNA, 64 nt, Human
ggccaggccucuuggcagucacaucucuuccuccgaggccaguaccuuuccauuuauucuuuga

SEQ ID NO: 2813 - RNA, 62 nt, Human
ggccauccccauagccauguuuacaugauuugaugugcaauagggugggguaggggcaggga

SEQ ID NO: 2814 - RNA, 61 nt, Human
ggccaugucagacacagauuggccagaaaccuuccugcugagccucacagcagugagacug

SEQ ID NO: 2815 - RNA, 62 nt, Human
ggccauugucauccauuucccaguuagggcaacaaugaaggaggacccagccaagcuagaag

SEQ ID NO: 2816 - RNA, 63 nt, Human
ggcccaaugagggaauccauugaacuggaagaaacacacuggauuggguaugucuaccuggca

SEQ ID NO: 2817 - RNA, 64 nt, Human
ggcccaaugagggaauccauugaacuggaagaaacacacuggauuggguaugucuaccuggcag

SEQ ID NO: 2818 - RNA, 63 nt, Human
ggccccaaccugugugcugggguccccagcagcaaacacuggaaagucuguuuuuuuuuuuuc

SEQ ID NO: 2819 - RNA, 64 nt, Human
ggcccccugcuggucgcuguuucggggacucggggcggccaguaccaccgccugaggcggggcu

SEQ ID NO: 2820 - RNA, 61 nt, Human
ggccccgcuguggggcugacuucuccccggccgccugcugaggagcucuccaucgccagag

SEQ ID NO: 2821 - RNA, 64 nt, Human
ggcccguucuuauagaugauuuuguagaauaugcacggccaguagucacagguggaaaacgcag

SEQ ID NO: 2822 - RNA, 63 nt, Human
ggcccuacccgagacuggugaaacuggaagucuucacacuggaguugcuguuccagcuggucg

SEQ ID NO: 2823 - RNA, 64 nt, Human
ggcccuacccgagacuggugaaacuggaagucuucacacuggaguugcuguuccagcuggucgc

SEQ ID NO: 2824 - RNA, 62 nt, Human
ggcccuccugugaguggggaagccgcccugcgguucaucucacagcgcgcagagacugcagc

SEQ ID NO: 2825 - RNA, 62 nt, Human
ggcccugucagcuggaacuggacagaccuugguuuguuuacauguccgaugggggcaggagc

SEQ ID NO: 2826 - RNA, 62 nt, Human
ggcccuucccagacugugauggccauccuggucccaguguuaggguagcaugggauuacagg

SEQ ID NO: 2827 - RNA, 61 nt, Human
ggccgaggcagguggaucacgaggucaggaguuugagauuagccuggccaagauggugaaa

SEQ ID NO: 2828 - RNA, 59 nt, Human
ggccgcgggaggacacugaggggcauccugcucaucucacacccugcauggaaucaggc

SEQ ID NO: 2829 - RNA, 62 nt, Human
ggccucaaggcccuggcacacagaagaugcguaucaguauuaucaaccaauaguugaugaau

SEQ ID NO: 2830 - RNA, 63 nt, Human
ggccucaccugcuggagucuuugguggccaggcaugugacuuaccugggauuucacuugccgg

SEQ ID NO: 2831 - RNA, 63 nt, Human
ggccuccaguucauuuuaaaaccaugaaaccacccacacuggagagccaccuucuuaaaugua

SEQ ID NO: 2832 - RNA, 63 nt, Human
ggccucugacaugagggacaugugacagugucauucaguauuauguucaaaagacauuuuuau

SEQ ID NO: 2833 - RNA, 62 nt, Human
ggccucugcaaaggaaauaccaguucugggcaaucaguguuaccguucaccaguugccguug

SEQ ID NO: 2834 - RNA, 61 nt, Human
ggccuggcccugucacugugguggaucaguggaccugcugaagucacuggacucaugugac

SEQ ID NO: 2835 - RNA, 62 nt, Human
ggccugggucaagaugagggucuuucaguguuccuguuuacaacaugucaaagccauugguu

SEQ ID NO: 2836 - RNA, 54 nt, Human
ggccuuacugagcauguaagggacucacacuggagagaaaccauaugaauguaa

SEQ ID NO: 2837 - RNA, 62 nt, Human
ggccuuagacuaauuuucgauuuucuuucuugaaauaagcuaauggcuuguuuguguaaagc

SEQ ID NO: 2838 - RNA, 62 nt, Human
ggcgaacagcuccaggugccccucuggagcuacccuaccucaucucccaagggagcggccac

SEQ ID NO: 2839 - RNA, 61 nt, Human
ggcgaacugcgagccccauucccagcucuucucccugcugacaucgucccuuaguuguggu

SEQ ID NO: 2840 - RNA, 63 nt, Human
ggcgaucuuuugauaugcuguuucacaggauccugacacuggagggcagcugucuugugcauu

SEQ ID NO: 2841 - RNA, 63 nt, Human
ggcgcguauggcagccgaggagcacacucugcaggacacuggacaagacaguaaauauucaac

SEQ ID NO: 2842 - RNA, 62 nt, Human
ggcgcuagaucaaggucacagcacugccuacaccuguuuacaaaaagaaucaaauaccacua

SEQ ID NO: 2843 - RNA, 62 nt, Human
ggcgcuagaugcaaggugcuagaccaaugggcugcaguauuauagcccccaggccuggcagg

SEQ ID NO: 2844 - RNA, 62 nt, Human
ggcgcuuccuaagugcugaaucgguuagccgugaucaucucacaguggcaugagcauugcuc

SEQ ID NO: 2845 - RNA, 63 nt, Human
ggcggagaggagccaagaaacuaaaggugaaaaauacacuggaacucuggggcaagagauguc

SEQ ID NO: 2846 - RNA, 61 nt, Human
ggcggcuucaggccucacuaaaggucaggcaguccugcugagcaggagggagaggaagggg

SEQ ID NO: 2847 - RNA, 62 nt, Human
ggcggggagcccaaggacauaacaaauuaaaagcaugaaggagagaaaaaugggggucgugg

SEQ ID NO: 2848 - RNA, 61 nt, Human
ggcuaaguauaagucugugaucugccuuaugagacugugaaugcauugucuuacucauguc

SEQ ID NO: 2849 - RNA, 61 nt, Human
ggcuacuuuuuagaaccagcaagcacuguugauacugugaaacaucccauuuuuuccguau

SEQ ID NO: 2850 - RNA, 64 nt, Human
ggcuaggacuucagaaaaguucaacugcucuggagcaacuggaaaguucagggcuucaaaauau

SEQ ID NO: 2851 - RNA, 61 nt, Human
ggcuauucccaaguacugcuacuugggcagcucccugcugagugaacauaucccagaccau

SEQ ID NO: 2852 - RNA, 63 nt, Human
ggcucagcauaccuucgugggccuuugauuuaccaacacuggaaaugccugccaacuaaucuu

SEQ ID NO: 2853 - RNA, 63 nt, Human
ggcucaguuagaaaaggacucccuggccaggcgcagugacuuacgccuguaaucucagcacuu

SEQ ID NO: 2854 - RNA, 64 nt, Human
ggcuccagggcgggaggcaagcccccuugccuuucaaacuggaaaccccagagaaaacggugcc

SEQ ID NO: 2855 - RNA, 62 nt, Human
ggcucccauccucaucucucuccuugacuggaauugcugcuacccagcuggggugggugagg

SEQ ID NO: 2856 - RNA, 63 nt, Human
ggcucccccagccccaaagccagcccccuucaucugugacuuaaucuguuguaguggugagcu

SEQ ID NO: 2857 - RNA, 62 nt, Human
ggcuccuggucaggcugcccguuguggggaggggcaguguuagagcagggcuggucauaccc

SEQ ID NO: 2858 - RNA, 62 nt, Human
ggcuccuuugaaaacaggucauauugugcucuucuguuuacaagaggaaacaagauggaaua

SEQ ID NO: 2859 - RNA, 62 nt, Human
ggcucgauggggcauuuggaacuucuuuuuaaagucaucucauggucuccaguuuucaguug

SEQ ID NO: 2860 - RNA, 62 nt, Human
ggcucucuguugugagaucuucagcuaccucauggugcaauaacacacacacgcuuaaccau

SEQ ID NO: 2861 - RNA, 61 nt, Human
ggcucuguuauuuacaaaaugaugcugugguucugagauuauuugggacauuuuuggcucu

SEQ ID NO: 2862 - RNA, 62 nt, Human
ggcugaaaacccaugcugcuguuauacacaauggcaguauuaacaagcauuuuaaaccuuug

SEQ ID NO: 2863 - RNA, 62 nt, Human
ggcugaacccucucaaagggcugucaccaucaccugcugcuaggacacuacaaaacaaucaa

SEQ ID NO: 2864 - RNA, 62 nt, Human
ggcugacaaccucguaagcccuugcuuagaaauacaguauuagucuaauugaguaauuagug

SEQ ID NO: 2865 - RNA, 62 nt, Human
ggcugagagaguuaagugaaugucuaaggucacacaguauuaagugacagugcuagaaauca

SEQ ID NO: 2866 - RNA, 63 nt, Human
ggcugcaagcaaggggcuagaaguucaccuccugacaguauuauuaauacuaugcaaauaugg

SEQ ID NO: 2867 - RNA, 62 nt, Human
ggcugcagagagccacuugucccacgucaccauuucaucucauuguaggcucaccuggcaca

SEQ ID NO: 2868 - RNA, 62 nt, Human
ggcugcauccucuucugucccuggcaccaggcuuuguuuacacuuggagccaccuuggugug

SEQ ID NO: 2869 - RNA, 63 nt, Human
ggcugccuccuuccuagaggcagcagggggagaaaacacuggaagaggucaccccaacaauuc

SEQ ID NO: 2870 - RNA, 61 nt, Human
ggcugcuuugcagggcuuuggcuguuaccuuucccugcugaggggcucagggaaaaggguc

SEQ ID NO: 2871 - RNA, 62 nt, Human
ggcugggacaccuccuggcccucacccugggucauguuuacaguccucagugccccacaccg

SEQ ID NO: 2872 - RNA, 62 nt, Human
ggcugguauugaguuguggacaucacuguugacccuaccucacgugccgagacucucauguc

SEQ ID NO: 2873 - RNA, 61 nt, Human
ggcugugccacacaagcacuucaucggggguuuugagauuagacacauuuuauaauggggg

SEQ ID NO: 2874 - RNA, 62 nt, Human
ggcugugcugauagugcugagggagauaggaauuugcugcuaagauuuuucuuuggggugga

SEQ ID NO: 2875 - RNA, 62 nt, Human
ggcugugucuaggcgcaagcacuuuagcaguaucuguuuacaugcgcaaggaucaagccgac

SEQ ID NO: 2876 - RNA, 61 nt, Human
ggcuuacuuggugcagugugcuguccagagagaccugcugacccagucugggacaggcaca

SEQ ID NO: 2877 - RNA, 64 nt, Human
ggcuucaccagugcccaagucucuauggagaaugagaacuggaagccacugcuaccgucuaccc

SEQ ID NO: 2878 - RNA, 62 nt, Human
ggcuucgacuccuauaagcagcacgugggcuuguucaucucacugcauguuuaugaagauac

SEQ ID NO: 2879 - RNA, 62 nt, Human
ggcuugauguucacaagaaaacagagugauaaaaugcugcuaaaauggaaaauaagagagga

SEQ ID NO: 2880 - RNA, 61 nt, Human
gggaaaauaucccucccaccugcaacagcugccccugcugacugcgccugucuucucccuc

SEQ ID NO: 2881 - RNA, 63 nt, Human
gggaaaauuuuaacugcaugguaugaauucagagugugacuuaagggucaauucaaagcagua

SEQ ID NO: 2882 - RNA, 62 nt, Human
gggaaagaguuuaauggaauauuuuuguacccgauguuuacagaugcuguugggaaguuauc

SEQ ID NO: 2883 - RNA, 62 nt, Human
gggaaagugagaagaaaauuaauguauuagcaaccaguguuagccaacucugcuguaauuac

SEQ ID NO: 2884 - RNA, 64 nt, Human
gggaaccuuacuuuccuuuuaguuauaaaugagauaaacuggaaaauuucaguuguaaaugaug

SEQ ID NO: 2885 - RNA, 64 nt, Human
gggaagcugcuaagaagcaggccaugaaacagaccaaacuggaaauccagaaggcccuugcaga

SEQ ID NO: 2886 - RNA, 61 nt, Human
gggaagguugugugcgccacugguacuuuugaaacugugaaauagguaucuuaauucaaau

SEQ ID NO: 2887 - RNA, 62 nt, Human
gggacagccaugugggacccccuggugauucagcaugaaggaaaugaagcuggagaggaagg

SEQ ID NO: 2888 - RNA, 62 nt, Human
gggaccauuguuuauaaauuuauugcuaaucuuacaguauuaggauucauuauaaaaaccaa

SEQ ID NO: 2889 - RNA, 61 nt, Human
gggacccacggggugugaccugcuugcuagagaacugugaacauguggcucuggauagagu

SEQ ID NO: 2890 - RNA, 61 nt, Human
gggacccuccuggcccaccaaggcccaggcaccacugugaauauucuccucugaaccacua

SEQ ID NO: 2891 - RNA, 62 nt, Human
gggaccuggauggccagcagggacaggggcauugucaucucaaaggcccaacccccagaggc

SEQ ID NO: 2892 - RNA, 63 nt, Human
gggaccuucccugcccugcugggggugcucuuuggacacuggauuaugaggaauggauaaaug

SEQ ID NO: 2893 - RNA, 61 nt, Human
gggacuccaggcaccaucuguucuccccagggaccugcugacuugaaugccagcccuugcu

SEQ ID NO: 2894 - RNA, 62 nt, Human
gggacuuuugccuuguuuguaauguuaaaguuuuuguuuacauugagaauauauucaaguuu

SEQ ID NO: 2895 - RNA, 62 nt, Human
gggagacaaaggaggaauuuacuuucuucaccaagugcaauagauuacugaugugauauucu

SEQ ID NO: 2896 - RNA, 61 nt, Human
gggagacucgaacucuagcccuggaucugccuuccugcugaaacuuguuccaccucagucc

SEQ ID NO: 2897 - RNA, 62 nt, Human
gggagagagaugcucagagaagauggagauagauauaagcuagacaauagcuuucuauauaa

SEQ ID NO: 2898 - RNA, 61 nt, Human
gggagaguauauaauggaggaaauauuauguauugagauuauauuuauuuucuaaaugcug

SEQ ID NO: 2899 - RNA, 62 nt, Human
gggagccccccaaccccuccccuccccucccuggugcugcuauugaacccccugccagcucc

SEQ ID NO: 2900 - RNA, 62 nt, Human
gggagcuuaguuccauuaaaaauuccuuaaagguugcugcuauuucugagucaccaguugca

SEQ ID NO: 2901 - RNA, 62 nt, Human
gggaggagugccaucugggucuuccaucuagaacuguuuacaugaagauaagauacucacug

SEQ ID NO: 2902 - RNA, 63 nt, Human
gggaggcaauugagggaaaggccugcuggccugggacacuggagacguggguuuaccacacag

SEQ ID NO: 2903 - RNA, 64 nt, Human
gggagggaugggguuauagcuguuuuguuuaauuggaacuggaagagggaucauguuuuguuuu

SEQ ID NO: 2904 - RNA, 62 nt, Human
gggagggggaggggcaggagcuuggaccuugguacuaccucagcugaggguggugacacaac

SEQ ID NO: 2905 - RNA, 61 nt, Human
gggaggucuuagcaggagcgggcccuguacccaccugcugaccugcuguuugguagagaaa

SEQ ID NO: 2906 - RNA, 63 nt, Human
gggaggugaugguaggaacccuguucuacugcaaaacacuggaaaaagagacugaaaaaaagc

SEQ ID NO: 2907 - RNA, 62 nt, Human
gggaguauacuaaauguuuacuuaagaaacacccuguuuacagccagaggagaaacacccaa

SEQ ID NO: 2908 - RNA, 62 nt, Human
gggaucuggaaaccagcaggccaggcagcauccacaguguuaguccaaagggucggaccgug

SEQ ID NO: 2909 - RNA, 62 nt, Human
gggaugaauguuuuuauaggguuuuuguuguaacauaagcuauuuucuagcgagcaugugac

SEQ ID NO: 2910 - RNA, 62 nt, Human
gggauggaguuucgcuguuguugcccaggcuggagugcaauagcacgaucuuggcucaccgc

SEQ ID NO: 2911 - RNA, 62 nt, Human
gggauggggcgcuccugauguacgugggccccgguguuuacaaggaggugaucaucuacaac

SEQ ID NO: 2912 - RNA, 62 nt, Human
gggauuaacauauuuuagacauucauuuuaaacacuaccucaguuaauauagaguauaaaaa

SEQ ID NO: 2913 - RNA, 64 nt, Human
gggauucucucccccaccccgaauucugucugcuuaaacuggaauacacaggagcccuuccugg

SEQ ID NO: 2914 - RNA, 61 nt, Human
gggauuucuuagagaucaccaaccgacucccucacugugaaauuaaaccaaguacuggaaa

SEQ ID NO: 2915 - RNA, 64 nt, Human
gggauuuggagugucacagacaagaggguugggggaggccaguagguauggauuuguuuauauu

SEQ ID NO: 2916 - RNA, 62 nt, Human
gggauuuguuacuuuagguuuguucccuugaauuucaucucaucaggcaaauuguacuaguu

SEQ ID NO: 2917 - RNA, 63 nt, Human
gggcaagaugagccaagcagaacauuccauccaggacacuggaaguucuccaggauccagauc

SEQ ID NO: 2918 - RNA, 50 nt, Human
gggcaaggcaaagcacuaaaagggccaguaccagugaguggccccaccug

SEQ ID NO: 2919 - RNA, 62 nt, Human
gggcacagaacccugugccccaccaggauuggccugcugcuaggggccaggggcccugacca

SEQ ID NO: 2920 - RNA, 62 nt, Human
gggcaccuccuugaagaagcugauagcuuuuacacaguauuagauugaaauaauggacagaa

SEQ ID NO: 2921 - RNA, 62 nt, Human
gggcacuaaacaaaacaaccaauaaagucaccagcaguauuacuaucacaccaacagccaca

SEQ ID NO: 2922 - RNA, 64 nt, Human
gggcagaucacaaggucaggaguucaagaccagccuggccaguauguugaaaccccaucucuau

SEQ ID NO: 2923 - RNA, 61 nt, Human
gggcagccccagccuaggccuugacucccgcugccugcugaggggcaauaaaccagaacca

SEQ ID NO: 2924 - RNA, 61 nt, Human
gggcaggacugccaccccaggccccgugggaggccugcugagggcacagagcugcucggug

SEQ ID NO: 2925 - RNA, 62 nt, Human
gggcagguguccaccagcagcucagccccugcagucaucucagagccccuucccgggccucu

SEQ ID NO: 2926 - RNA, 64 nt, Human
gggcaucagcauagugccacccccugcuccugaccuggccaguacuucacagugcucuugaggu

SEQ ID NO: 2927 - RNA, 61 nt, Human
gggcauggcaaauuccucaucgcugcccagaacccugcugaugagcccacuccaggggccc

SEQ ID NO: 2928 - RNA, 61 nt, Human
gggcauggcaaauucugacccauugcccagaacccugcugaugagcccacucuaggagccc

SEQ ID NO: 2929 - RNA, 64 nt, Human
gggcauggccugagucagaagagcuaccccaggugaaacuggaagugcaugaggcagagcgucc

SEQ ID NO: 2930 - RNA, 61 nt, Human
gggccaggggaacccgugaggaucacucucaaaugagauuaaaaacaaggaagcagagaau

SEQ ID NO: 2931 - RNA, 62 nt, Human
gggcccacauccggggccagcuccggcguguguucaguguuagcagugggucaugaugcucu

SEQ ID NO: 2932 - RNA, 62 nt, Human
gggcccacuugagggcgaugauucuagaaggguuauaagcuaaacacacuuguuaacauccu

SEQ ID NO: 2933 - RNA, 62 nt, Human
gggcccgcugggcaccuggcaccuggccugcagaugcugcuacgagugaccagugcugugug

SEQ ID NO: 2934 - RNA, 62 nt, Human
gggccggggagucccugucucucacagcaucuagcaguauuauuaaauggauucauuuuaaa

SEQ ID NO: 2935 - RNA, 63 nt, Human
gggccucaaggcccuggcacacagaagaugcguaucaguauuaucaaccaauaguugaugaau

SEQ ID NO: 2936 - RNA, 61 nt, Human
gggccugaaucuccugaacuacagccaguuuccugagauuagaaccuguguguaugcacau

SEQ ID NO: 2937 - RNA, 62 nt, Human
gggccuucugacuccuuguccagucaguguucuuucaucucaccacagcugccuccuuugaa

SEQ ID NO: 2938 - RNA, 63 nt, Human
gggcgcuagaugcaaggugcuagaccaaugggcugcaguauuauagcccccaggccuggcagg

SEQ ID NO: 2939 - RNA, 61 nt, Human
gggcggccugcacagagcugcugcccuccagagacugugaaucccaagccugacucagugg

SEQ ID NO: 2940 - RNA, 62 nt, Human
gggcguagucaggcaaugcugugugcgaaguaaacuaccucaagguaugaaguuaccucagc

SEQ ID NO: 2941 - RNA, 61 nt, Human
gggcuaccggcaguccucuguaguccagagaggugagauuagaucuucuugguucccugug

SEQ ID NO: 2942 - RNA, 64 nt, Human
gggcucaagugauccuccuaccugagccuucugaguaacuggaacuacaggugugcacuccucg

SEQ ID NO: 2943 - RNA, 62 nt, Human
gggcucuccggcaggcagcccgagaccugcacagaugaaggagcagagguucugaccgagag

SEQ ID NO: 2944 - RNA, 64 nt, Human
gggcucuguggggcacaugauuuauccauaaaggagaugcaguaugcuuacuuaaauuaauaaa

SEQ ID NO: 2945 - RNA, 63 nt, Human
gggcugacaaccucguaagcccuugcuuagaaauacaguauuagucuaauugaguaauuagug

SEQ ID NO: 2946 - RNA, 62 nt, Human
gggcugggacauggggguguggguaaagacagggaugaaggauagaggcugagagaagaagg

SEQ ID NO: 2947 - RNA, 62 nt, Human
gggcugggauccucuccucccgcuguaaccauuucuaccucauuuugcugcguguuguacau

SEQ ID NO: 2948 - RNA, 62 nt, Human
gggcuggguguguguccugguucuuagugaaaggucaucucaugucuguuuaauacauggug

SEQ ID NO: 2949 - RNA, 62 nt, Human
ggggaauauaugaauuguuuaacaaauuagaauuuguuuacaacuacuugaauuuuuaaauu

SEQ ID NO: 2950 - RNA, 61 nt, Human
ggggaccgcagggggcagccagggcuggggaacacugugaaaguuacuuggggaggguggg

SEQ ID NO: 2951 - RNA, 61 nt, Human
ggggagucacgauuggggugggagaugagcaaaccugcugaauaaaguuaaaacguuauuu

SEQ ID NO: 2952 - RNA, 62 nt, Human
ggggauuuuauucaucccgucugagcucuucauacaguauuaccauuagguuuuaagaacaa

SEQ ID NO: 2953 - RNA, 63 nt, Human
ggggcacuaaacaaaacaaccaauaaagucaccagcaguauuacuaucacaccaacagccaca

SEQ ID NO: 2954 - RNA, 61 nt, Human
ggggcagacccugccuuggagggagacuccgagccugcugaaaggggcagcugccuguuuu

SEQ ID NO: 2955 - RNA, 62 nt, Human
ggggcagagcaucugugggguggggucuuccccuugcugcuauuguauggcuggggacuggu

SEQ ID NO: 2956 - RNA, 62 nt, Human
ggggcagggcauuauuaggcuauuucugaugcuucaguguuauaaauucaacauagaggcug

SEQ ID NO: 2957 - RNA, 63 nt, Human
ggggcagugccacuuucuacaaccugccaacccacacacuggaguaauucugaaaaaaauuau

SEQ ID NO: 2958 - RNA, 64 nt, Human
ggggccagccugaggacccccgccuaccaccucgagaacuggaagccaaccucuaaccuccuga

SEQ ID NO: 2959 - RNA, 62 nt, Human
ggggccagcggcagcgggucagucuggcucgagcuguuuacagugaugccgauauuuucuug

SEQ ID NO: 2960 - RNA, 64 nt, Human
ggggccucagaauucauugaagauuuguuuugggacaacuggaagaaucagcaccauggauacu

SEQ ID NO: 2961 - RNA, 62 nt, Human
ggggcugauguguaaagcuguucaaguuauuugauguuuacaccucagggaaagucuugugu

SEQ ID NO: 2962 - RNA, 62 nt, Human
ggggcuuggcugagagaguggcauuggcagcaggugcugcuacccucccugcuguccccucu

SEQ ID NO: 2963 - RNA, 62 nt, Human
gggggauagugagaaccuaagccccaucguagcacaguauuacaugugguugggaaaaauaa

SEQ ID NO: 2964 - RNA, 62 nt, Human
gggggaucucagcgcagagaaguugagaggacccaugaaggaagcaaggacacggggcaggc

SEQ ID NO: 2965 - RNA, 62 nt, Human
gggggggaucgaaaagaagguauuuuuccaaucacaguguuauguaguauuguucuauuuuu

SEQ ID NO: 2966 - RNA, 62 nt, Human
gggggggcgugggucaaaucauagccaagugacuuguuuacaugugagugaaacugcacaaa

SEQ ID NO: 2967 - RNA, 62 nt, Human
gggggugaugcuuucauauugaccucaccccauacuaccucacagauguguugugaggauua

SEQ ID NO: 2968 - RNA, 62 nt, Human
gggggugcguacuagcacgugcccaguugcucagugcugcuaguagaaauugauuugcauag

SEQ ID NO: 2969 - RNA, 62 nt, Human
gggggugggccguggagucggaguggacaccgcucaguauuacuuucugccgcugucaaggc

SEQ ID NO: 2970 - RNA, 61 nt, Human
gggguagaccuaaggguguuuguuagucucaaaacugugaagugacaugucagaacagucc

SEQ ID NO: 2971 - RNA, 62 nt, Human
gggguauuaacuuuuuuagaaugacacagcugaacaguguuaauaauagugugucaagauug

SEQ ID NO: 2972 - RNA, 63 nt, Human
ggggucaggaacacuacacugcacaggaagccuucacacuggaagggggaccugcgcccccac

SEQ ID NO: 2973 - RNA, 62 nt, Human
gggguccccggccccccugugcccuguuccccaccuaccucagcugggucaggcacagggag

SEQ ID NO: 2974 - RNA, 61 nt, Human
ggggucuaaagcuuuuggggaugaaaugggaccccugcugauucuuucugcuucuaagacu

SEQ ID NO: 2975 - RNA, 62 nt, Human
gggguuggguuugggguucaggaugcugcagucugugcaauaauaaacccgcaucugcucac

SEQ ID NO: 2976 - RNA, 61 nt, Human
gggguuggugagagggcaaacccugauauuuuuacugugaagguguuuucaguuguucuua

SEQ ID NO: 2977 - RNA, 61 nt, Human
ggguaaaggccuccccugagaacacaggacaggccugcugacaaggcugagucuaccuugg

SEQ ID NO: 2978 - RNA, 62 nt, Human
ggguaagggaauagaucacucagauguauuuuagauaagcuauuuagccuuugauggaauca

SEQ ID NO: 2979 - RNA, 64 nt, Human
ggguaccugggaaaggguguggcugaggcagucauaaugcaguaucuuccccugacuccagcca

SEQ ID NO: 2980 - RNA, 61 nt, Human
ggguauagugagucgugauuguaccacugcauuccugcugagcaacagagugagaccccau

SEQ ID NO: 2981 - RNA, 61 nt, Human
gggucagccggccgugugcgucccccgacagacacugugaacggaagacagcaggccgcga

SEQ ID NO: 2982 - RNA, 61 nt, Human
gggucauccuugccuacgugcuggaaaaacgugccugcugagagagugcccucaauucccu

SEQ ID NO: 2983 - RNA, 64 nt, Human
gggucaugugcguuuccuagcuucaggcuacuugguaacuggaagaagcuggaggacagaagca

SEQ ID NO: 2984 - RNA, 62 nt, Human
ggguccaacaagaacaccugacuugggugaaguugugcaauauuggaggcugacuguagggc

SEQ ID NO: 2985 - RNA, 62 nt, Human
gggucccggaagccccuucuggcugcaccugccauguuuacagagggccccugggcugcgcg

SEQ ID NO: 2986 - RNA, 62 nt, Human
gggucucuacaagugacagauguguuguuuucaacaguauuauuagguuaugaauaaagccu

SEQ ID NO: 2987 - RNA, 63 nt, Human
gggucuggagggacagagaacaguucccugauuaacaguauuaauagcgacauugguaacagc

SEQ ID NO: 2988 - RNA, 61 nt, Human
gggucuuggcugcugccuuacuucccagaggcuccugcugacuucggaggggcggaugcag

SEQ ID NO: 2989 - RNA, 62 nt, Human
gggugaaggaggucaggccccacuccuuccugauuguuuacagucauuggaauaaggcaugg

SEQ ID NO: 2990 - RNA, 61 nt, Human
gggugaccaggcgaggagggagccgagacgucaacugugaaggguuccugugauugcguuu

SEQ ID NO: 2991 - RNA, 63 nt, Human
gggugagagggauuccuaaucacucagagcagucugugacuuaguggacaggggagggggcaa

SEQ ID NO: 2992 - RNA, 61 nt, Human
gggugaggagcuggggaucccucccccccaugcacugugaaggacccuuguuuacacauac

SEQ ID NO: 2993 - RNA, 61 nt, Human
gggugccccacucacuucucugagaucgaacggacugugaauccgcucuuugucggaagcu

SEQ ID NO: 2994 - RNA, 64 nt, Human
ggguggaaaacuuaucuugaugggcaguacaggaagaugcaguagaccuuaagauguccugaaa

SEQ ID NO: 2995 - RNA, 61 nt, Human
ggguggcagcguccccgccugcaccagugccguccugcugaugugguaggcuagcaauauu

SEQ ID NO: 2996 - RNA, 62 nt, Human
ggguggcauguguugggauauacuggcuacaggcucaucucaaagagcagguagaacagagu

SEQ ID NO: 2997 - RNA, 62 nt, Human
ggguggccccguggggguagcucacucccccuccugcugcuaugccugugacccccgcggcc

SEQ ID NO: 2998 - RNA, 62 nt, Human
gggugugauuucuauaccaaagauaugcuuauuucaguauuagaaaaauauucuucuuacau

SEQ ID NO: 2999 - RNA, 62 nt, Human
gggugugccuucugccuccaccccugcaaaagcccuaccucaggucagagacagagcaaaag

SEQ ID NO: 3000 - RNA, 61 nt, Human
ggguguuggauuccucuguuguugucaucaauuccugcugagggguuucugggguuuuguu

SEQ ID NO: 3001 - RNA, 62 nt, Human
ggguuaaaaauuaucaguuuaaucucuuuaagaacaguauuaucagaguuuaaaaugaguua

SEQ ID NO: 3002 - RNA, 61 nt, Human
ggguuacuguucaaugacagcagguaaccuauaacugugaaugcuucgugucgucaguauu

SEQ ID NO: 3003 - RNA, 62 nt, Human
ggguuauauaccauauguuaaauaugcaauaaaguguuuacaggaugcccuucugaagggua

SEQ ID NO: 3004 - RNA, 64 nt, Human
ggguucaagugauucuccugucucagcucccugaguaacuggaauuacaggugcacgccaccac

SEQ ID NO: 3005 - RNA, 62 nt, Human
ggguucaguaccauggacagcgcccucgacccgcuguuuacaaccaugaccccuuggacacu

SEQ ID NO: 3006 - RNA, 64 nt, Human
ggguucauguucuuggacugcgggcccucaguccuuaacuggaaagugaccguccacugcccca

SEQ ID NO: 3007 - RNA, 63 nt, Human
ggguuccagacugguuggacuuguucgucuggacgacacuggaguggaacacugccucccacu

SEQ ID NO: 3008 - RNA, 62 nt, Human
ggguuccugcaccuggaauccaguguguccaagccaguauuaaauuaucucaacacugaccc

SEQ ID NO: 3009 - RNA, 62 nt, Human
ggguugacucagagagucgcugucauucugucauugcugcuacucuaacacugagcaacacu

SEQ ID NO: 3010 - RNA, 62 nt, Human
ggguugcuguauauauauuccgggcaauauaugagugcaauaacaauacaagauauugaaua

SEQ ID NO: 3011 - RNA, 61 nt, Human
ggguugggggaucggcaguugggaggggcgcucugagauuaaagaguuuuaccucugagau

SEQ ID NO: 3012 - RNA, 62 nt, Human
ggguuuuguuagagaaccuaaaaucuuuacacuuucaucucaaagauuauaaaggaaagggg

SEQ ID NO: 3013 - RNA, 62 nt, Human
gguaaacuuuagucccauuauauacuuuuggggacaguguuauaaaucagaauuuuacgaca

SEQ ID NO: 3014 - RNA, 64 nt, Human
gguaaagaucaugguuaaguauaaucauuacugccaaacuggaauuuucaaguuauuauaauau

SEQ ID NO: 3015 - RNA, 61 nt, Human
gguaaaugguaaggaauuugggguggaaugugaugagauuaaaauguagcuuugguauaac

SEQ ID NO: 3016 - RNA, 62 nt, Human
gguaaucuuuuacgggugggaggugagauugauagugcaauaaucagugaucuauagacccu

SEQ ID NO: 3017 - RNA, 61 nt, Human
gguaauuacaucuugaaaguggaacccucaugaugagauuaugugucuuaugagacaacac

SEQ ID NO: 3018 - RNA, 62 nt, Human
gguaauucuuaagcucgagaaagaguuugagaacugcugcuaggaaauagagauucacauuu

SEQ ID NO: 3019 - RNA, 61 nt, Human
gguaauuuucugcucauuuuuugucucagugauacugugaaaggugcagucucaggggaac

SEQ ID NO: 3020 - RNA, 61 nt, Human
gguacuaccccuuuuuuucauuucaaacuugaaacugugaauaagguaagaaaacuauuuu

SEQ ID NO: 3021 - RNA, 62 nt, Human
gguacuauuugccauuuaaaacuagaacagguauauaagcuaauauugauacaaugaugauu

SEQ ID NO: 3022 - RNA, 62 nt, Human
gguacuuuuuuuaagcuaagucagcauugucuuccaguguuaaaggcaucccucaccucugc

SEQ ID NO: 3023 - RNA, 62 nt, Human
gguagauuuucaagagugugaacacaaauuuaaaauaagcuauaaucagcaacaacacaaug

SEQ ID NO: 3024 - RNA, 64 nt, Human
gguagcacagcacuuugguuuugcugagaucgaagaggccaguaggagacacgacagcacacac

SEQ ID NO: 3025 - RNA, 61 nt, Human
gguagugacagcaaagcugaguuaaaggucaccccugcugagaaagaugggcauugauaaa

SEQ ID NO: 3026 - RNA, 64 nt, Human
gguaguuaauuggauuuaauauuuguauuaaggauuaacuggaaaaaaugugucucagugcuaa

SEQ ID NO: 3027 - RNA, 63 nt, Human
gguauaguaguuaucuuaaaauauacacuccuaagcaguauuauuuuaaaauccuuuacccug

SEQ ID NO: 3028 - RNA, 62 nt, Human
gguauccuguuuuugaacucagcuuaagaacuucucaucucaaauccuauggccuucuggaa

SEQ ID NO: 3029 - RNA, 63 nt, Human
gguauuaaagauguguuguugguuuccaaaaaggaacacuggaaaauaaauuuugaauguuua

SEQ ID NO: 3030 - RNA, 62 nt, Human
gguauuugcugauaaaaggcauaacgagacauagugcugcuaccacugaauaagugauacuu

SEQ ID NO: 3031 - RNA, 64 nt, Human
gguauuuggugcuuauuaaaaaugugguuuguuuugaacuggaagcaaguugaccaaggacuua

SEQ ID NO: 3032 - RNA, 62 nt, Human
gguauuuucacugaacaaggucaauugguuaccucaguauuacagccaauauaguccaaggg

SEQ ID NO: 3033 - RNA, 61 nt, Human
ggucaacacuacuacgccuuagccacccgucacccugcugacugcgacuucccucugcagc

SEQ ID NO: 3034 - RNA, 63 nt, Human
ggucacuaaacucaggauuggcgugugcuuuuagaacacuggaguagcccuuguuuuagaggc

SEQ ID NO: 3035 - RNA, 62 nt, Human
ggucagaguagaaccccugaaguauuuuuuaauccuaccucaaaauuuaacaguuaccugag

SEQ ID NO: 3036 - RNA, 63 nt, Human
ggucaguauuuuuccagcauuuaaauugaaacggucaguauuagaccacugcuagguuaugua

SEQ ID NO: 3037 - RNA, 64 nt, Human
ggucagugagcaaccuugcuagcaaugguaaucaagaacuggaacuucacagacagcagcucuc

SEQ ID NO: 3038 - RNA, 61 nt, Human
ggucaucauucuagaccugauaaccacugagaaccugcugagcaaggacggcuuuuaccaa

SEQ ID NO: 3039 - RNA, 62 nt, Human
gguccagugugcccugcgaugggucccgugucacuguuuacaugaccuauuugugugguuau

SEQ ID NO: 3040 - RNA, 62 nt, Human
ggucccugauccgccccagccugcaggccagaagcaguguuacacacuuccuggaggagcua

SEQ ID NO: 3041 - RNA, 64 nt, Human
gguccgaugccugggaggaccagaagccaacagcaaaacuggaaaagcccggcaggcccaggag

SEQ ID NO: 3042 - RNA, 62 nt, Human
gguccuggcugagccaaggaguaauggaccagaucuaccucaguauucaaguucagugggga

SEQ ID NO: 3043 - RNA, 61 nt, Human
ggucgcagccaugaagugucaccaguaucuacuacugugaagucagcugugcuguuuucca

SEQ ID NO: 3044 - RNA, 62 nt, Human
ggucuggagggacagagaacaguucccugauuaacaguauuaauagcgacauugguaacagc

SEQ ID NO: 3045 - RNA, 61 nt, Human
ggucugucaggagacagaggcuuuuuugaauucacugugaagagaagaacccgaaccuuaa

SEQ ID NO: 3046 - RNA, 63 nt, Human
ggucuuauggauaagguacaugaagauuuuugcagcaguauuagugguucaguggcugcacuu

SEQ ID NO: 3047 - RNA, 62 nt, Human
ggucuucccuugagcuccaggggguggaacccaauguuuacauucucuucugucucugcccc

SEQ ID NO: 3048 - RNA, 62 nt, Human
ggugacacaccgugagacaggugaggugauggugaugaaggagcugauccgguucgacgagg

SEQ ID NO: 3049 - RNA, 64 nt, Human
ggugagaaucuaauaacauuaaaaugcuggggcaagaugcaguacaaaguugaagagacuuuau

SEQ ID NO: 3050 - RNA, 62 nt, Human
ggugaggggcucagaggaauacuuggaacaacagcaguguuauuguaguguggcaguuucuu

SEQ ID NO: 3051 - RNA, 62 nt, Human
ggugauguccuucuagccaaagaugcugcugcuccuaccucacugccugucccagagcaggc

SEQ ID NO: 3052 - RNA, 60 nt, Human
ggugauuccgaaauccuaaggccugccucgcaccugcugagccgcacugcugccccuggc

SEQ ID NO: 3053 - RNA, 62 nt, Human
ggugcaagaacaaugaggaaguugauccuguaacaugaaggaaguguaacuguuucacguag

SEQ ID NO: 3054 - RNA, 61 nt, Human
ggugcagauggccccgggcggcccagguccucuacugugaaggagcagggagcugccgagg

SEQ ID NO: 3055 - RNA, 62 nt, Human
ggugccuucagcuacuucggcuucuuaaacccugcaguguuaaacagaggcauugagaaagg

SEQ ID NO: 3056 - RNA, 61 nt, Human
ggugcuagcuccuuuuuagaaugucagcagagcugagauuaauaucugggcuuuuccugaa

SEQ ID NO: 3057 - RNA, 63 nt, Human
ggugcugagaauccuacccuuccuugcugucacuacaguauuaauauuuuacuguauuuucuu

SEQ ID NO: 3058 - RNA, 61 nt, Human
ggugcugagggccccuuucugcuucucugcccaccugcugaguugccacucgcaguguugu

SEQ ID NO: 3059 - RNA, 62 nt, Human
ggugcuuucuguauuuccagcugagguaccuggcucaucucauugggacugguuagacagug

SEQ ID NO: 3060 - RNA, 62 nt, Human
gguggaaccucaagaaugacuuuauucuuguaucucaucucaaaauauuaauaauuuuuuuc

SEQ ID NO: 3061 - RNA, 64 nt, Human
gguggauguguaguuucugguuuuaaaauucaagcaaacuggaaaauaauccaucuaauuaugc

SEQ ID NO: 3062 - RNA, 62 nt, Human
gguggcggaggaacuccugccacgccacugugucaugaaggaaagugaaagggaacgaggaa

SEQ ID NO: 3063 - RNA, 63 nt, Human
gguggcugcgcccccagcuucucucucccugucacacacuggaccccacuggcugagaaucug

SEQ ID NO: 3064 - RNA, 62 nt, Human
gguggcugggcaggggucagugccacggccuccuuguuuacaugaaguggaagcuugaccag

SEQ ID NO: 3065 - RNA, 62 nt, Human
ggugggccggggagggguccuuugcggugagcuauguuuacaugacacagugugccaaagug

SEQ ID NO: 3066 - RNA, 63 nt, Human
gguggggaaggugccuauuuuagagaacuuugucacaguauuaaaguucccggggcccacauc

SEQ ID NO: 3067 - RNA, 62 nt, Human
ggugggggggcuuaucuggguggguggggaugccuguuuacacuagcgcugacucccaacgg

SEQ ID NO: 3068 - RNA, 64 nt, Human
ggugggguacaaaggggcccaugcaggagaugcccuggccaguaggaccuccaacagguuguuu

SEQ ID NO: 3069 - RNA, 62 nt, Human
ggugguguucugguaaaauuguuagaauagcuguaugaaggaaaccagugggaggaaaugaa

SEQ ID NO: 3070 - RNA, 62 nt, Human
gguguauugguguugcagccgcagagaaaugccccaguguuauuuauuccccagugacucca

SEQ ID NO: 3071 - RNA, 62 nt, Human
ggugucagauaaugcucguaaaugccuuaguccaucaucucaguaaauuuuuuuuauaacac

SEQ ID NO: 3072 - RNA, 64 nt, Human
ggugugccucguccugcccgcacugccucucccaggaacuggaaaagcccuguccggugagggg

SEQ ID NO: 3073 - RNA, 62 nt, Human
gguguguugcaaugcccugaagguacggccgcucugcugcuacaggguucggcaucgucugg

SEQ ID NO: 3074 - RNA, 62 nt, Human
gguguucauguuuuauacauguaagucuguuggcaugaaggaccauuuucuacauaauauga

SEQ ID NO: 3075 - RNA, 61 nt, Human
gguguuccuaccaggacucaagagacaccccuuccugcugacauucccaucacaacauucc

SEQ ID NO: 3076 - RNA, 62 nt, Human
gguguuuguucauccugccauccccaacccuuuucuaccucaagucugugugaccacucaca

SEQ ID NO: 3077 - RNA, 62 nt, Human
gguuaaaucaucuuuacaaaaugugugcuuuaacuguuuacaaguaaaaccuaaaguugcag

SEQ ID NO: 3078 - RNA, 61 nt, Human
gguuagccagagacagguuuucauuaucaggucacugugaaaucugguaaggcaguccuga

SEQ ID NO: 3079 - RNA, 62 nt, Human
gguucaaacucugcauccuucucuaacaacgugacuaccucaugucugcuucaaggcccccg

SEQ ID NO: 3080 - RNA, 62 nt, Human
gguucauuuuuguuuguuuuguuuuguuuuguuuuguuuacagaugaggucuuccuguguug

SEQ ID NO: 3081 - RNA, 61 nt, Human
gguuccaguacugguuuuccaacuuaauacaaaacugugaauacuuucucaccauuccuca

SEQ ID NO: 3082 - RNA, 62 nt, Human
gguuccuggacuaagguccggcucguucaagaacauaagcuaccaccuucucccuccccacc

SEQ ID NO: 3083 - RNA, 63 nt, Human
gguucuaaucauuucagcaguagcgucuuaaacagcaguauuacuauaagcaguugcuucaaa

SEQ ID NO: 3084 - RNA, 61 nt, Human
gguugauuuagguugcacauucacugaauucacugagauuauuccuauaauuuuaaaguau

SEQ ID NO: 3085 - RNA, 62 nt, Human
gguuggacguuucuuccccaucaggguagaaaaaucaucucaaacuagccaaaaggcaguuu

SEQ ID NO: 3086 - RNA, 61 nt, Human
gguuggugccaggcugucauucagaacacagccacugugaaagugcuuuggcaacugugag

SEQ ID NO: 3087 - RNA, 62 nt, Human
gguugucuuuugagcccccagugucugguuucauucaucucagacuuguuauuucacucauc

SEQ ID NO: 3088 - RNA, 64 nt, Human
gguuuagccuccuucgcaggcauguccuggacaccgggccaguaucuauauauguguauguacg

SEQ ID NO: 3089 - RNA, 64 nt, Human
gguuucauuugagugccuucguguguauguccaucaaacuggaaccaaacuguuuuguaaguaa

SEQ ID NO: 3090 - RNA, 62 nt, Human
gguuucccuaucuguaaaauggggccaaugacaccuaccucacugggucaccaucgagauca

SEQ ID NO: 3091 - RNA, 62 nt, Human
gguuuccucaucuguaauguggggaucauaacaccuaccucauggaguuguggugaagauga

SEQ ID NO: 3092 - RNA, 62 nt, Human
gguuucuuaauagcuuuucucuaccacuaauuacuuccguuaaaaaaaaaaagaaauaccca

SEQ ID NO: 3093 - RNA, 63 nt, Human
gguuugaagaaauaacaaauuaaaagcuauauauaaacgguuaacaauauuagguggacauau

SEQ ID NO: 3094 - RNA, 61 nt, Human
gguuugcauucccagguagaacaggugucguacacugugaaauguuccagguuauuuguuu

SEQ ID NO: 3095 - RNA, 61 nt, Human
gguuugccaaguaggaugaagacucuaaguguuccugcugaguuguccaaagguccugcuc

SEQ ID NO: 3096 - RNA, 61 nt, Human
gguuugccaaucucuguuuuauaccauuaacuaugagauuaacaaaaacuuuuaccuuugu

SEQ ID NO: 3097 - RNA, 63 nt, Human
gguuuuacuguaaugguaaggauugacucaagagacaguauuaguaaauuuauuguguaugga

SEQ ID NO: 3098 - RNA, 62 nt, Human
gguuuuacuuccuuguuaacauauaaaguuauaaaugaaggacaaggaggagauggaaaaug

SEQ ID NO: 3099 - RNA, 64 nt, Human
gguuuuauuuggucucaucuugucuaugagaguugaaacuggaacugggaaaccuaagaugggu

SEQ ID NO: 3100 - RNA, 64 nt, Human
gguuuuuaaguccucuaaacacacuugggcacggaaaugcaguacuguaaggaagagggaccuc

SEQ ID NO: 3101 - RNA, 64 nt, Human
guaaaaaaugaagucugacuagaauucuauugcagaggccaguacauuuaguauggcauugagu

SEQ ID NO: 3102 - RNA, 62 nt, Human
guaaaaauaagaacauugaggagcagucagagcccaguguuaaucuccggcagagauggggu

SEQ ID NO: 3103 - RNA, 62 nt, Human
guaaaaauuauaaaaugggggauaauuauaauaccuaccucauaaugcuuugugaggauuaa

SEQ ID NO: 3104 - RNA, 63 nt, Human
guaaaaccauaaacauuugccaaaaauucaugccccaguauuagcaaugaauuaguugcauug

SEQ ID NO: 3105 - RNA, 62 nt, Human
guaaaauggggaucaauaauaacuccugcccugccuaccucacaggguuguugugaggauca

SEQ ID NO: 3106 - RNA, 62 nt, Human
guaaaauuugcuucauggucaugaccccauuagucaguguuacagcuguguuggggauagga

SEQ ID NO: 3107 - RNA, 62 nt, Human
guaaacugucagggugauaaaauguuucucuugauguuuacaugcacaagcuuugcguucug

SEQ ID NO: 3108 - RNA, 61 nt, Human
guaaagaugguuuuacacacuauagaugucuauacugugaaaaguguuuucaauucugaaa

SEQ ID NO: 3109 - RNA, 63 nt, Human
guaaaucaucaaaaugagaucauaaguguuaauguacacuggacaugaaaacaaagacugguu

SEQ ID NO: 3110 - RNA, 62 nt, Human
guaacaaagagaaaugugcaaauauuuuuuaaggcaguauuaagugcaagaggaguaacaug

SEQ ID NO: 3111 - RNA, 62 nt, Human
guaacacuugaaaaguguguuuagauuuauuuuuucaucucauuuuuaagaacaagcaguac

SEQ ID NO: 3112 - RNA, 62 nt, Human
guaacauaucugaagugguuauuuuuuucuuuccaugaaggaaaccuuuuggaauuaagaua

SEQ ID NO: 3113 - RNA, 62 nt, Human
guaacugcaguauuuuguacaagugucuaaacauuguuuacaagacuaaggcccacuucccu

SEQ ID NO: 3114 - RNA, 63 nt, Human
guaacugcucaguagguuacaaaugaagaguccaccaguauuagaaacaauuuaaacuugcca

SEQ ID NO: 3115 - RNA, 62 nt, Human
guaacuucuaauggccaucuguaaaccauaaguaaugaaggacuccacugugccccacuuuc

SEQ ID NO: 3116 - RNA, 62 nt, Human
guaacuugggguugaacuaaaacaccuguccugccuaccucacaaggucacucugaggauug

SEQ ID NO: 3117 - RNA, 62 nt, Human
guaagaaguguuauuggcaaagcaauccaauaaaauaagcuaccugugaugcuccccuggga

SEQ ID NO: 3118 - RNA, 62 nt, Human
guaagcaaacuguaugacaagacuacuauugcaaaugaaggauauuuauagcuaaacugcgc

SEQ ID NO: 3119 - RNA, 62 nt, Human
guaagcuuuauaaaaacucauuugcacuggacugucaucucauucuuguacaacguagaauu

SEQ ID NO: 3120 - RNA, 61 nt, Human
guaaggcggccaaagaaggaugcggagcccagcacugugaagccuacaaaaacauugaugc

SEQ ID NO: 3121 - RNA, 62 nt, Human
guaagggacucugcaagcuuguuguucagcaccgcaguguuaccucuuggcaagcugugaac

SEQ ID NO: 3122 - RNA, 61 nt, Human
guaaguuuccugaggccuccccagucauacagaacugugaaucaauuuaaccucuuuccuu

SEQ ID NO: 3123 - RNA, 61 nt, Human
guaaguuuccugaggccuccucagccauguggaacugugaaucuauuaagccucuuuucuu

SEQ ID NO: 3124 - RNA, 63 nt, Human
guaauaaaggucaaacaucagugagcaagcuguguacacuggaaaacacugaaucaauacaau

SEQ ID NO: 3125 - RNA, 63 nt, Human
guaauacucuguuacacaggguaauauuaucugcuacacuggaaggccgcuaggaagcccuug

SEQ ID NO: 3126 - RNA, 63 nt, Human
guaaucagauuaagauugaccauugcuccuuuacacaguauuagucuagcauucaauuauuuc

SEQ ID NO: 3127 - RNA, 62 nt, Human
guaaucccauggggcguguaccauuuggagacacaugaaggauacaguagacagcacggaag

SEQ ID NO: 3128 - RNA, 64 nt, Human
guaauguaguugaaaucauacaguauauagcuuuucaugcaguauauagcuuuucagauuggcu

SEQ ID NO: 3129 - RNA, 62 nt, Human
guaauuagauuauguauagggguaacuggaagccaugaaggaaggacuuaaccaggcuacca

SEQ ID NO: 3130 - RNA, 61 nt, Human
guaauuuuuuauguaauuuuuugguauagcaaaacugugaaaaagccaaauuaggcauaca

SEQ ID NO: 3131 - RNA, 62 nt, Human
guacaauaugaagccuucauuuaaucucugcaguucaucucauuucaaauguuuauggaaga

SEQ ID NO: 3132 - RNA, 63 nt, Human
guacaauuuaucuaaacugaauugagaaaaaauuacaguauuauuccucaaaauaacaucaau

SEQ ID NO: 3133 - RNA, 63 nt, Human
guacaccacuuucccacacugugaacuaaugacaagugacuuauuugcucauaaguaaauguc

SEQ ID NO: 3134 - RNA, 62 nt, Human
guacacgaagugcuaaccagguaucuugauaaauuguuuacaguagguauugagaaaccuca

SEQ ID NO: 3135 - RNA, 62 nt, Human
guacacuguuuccauguuauguuucuacacauugcuaccucagugcuccuggaaacuuagcu

SEQ ID NO: 3136 - RNA, 64 nt, Human
guacagaugcugguuguauuaccacgucaauguccuaugcaguauuguuagacauuuucucauu

SEQ ID NO: 3137 - RNA, 62 nt, Human
guacauucacccucuagugcagccccucaguuuaaugaaggaaaaaaaaacaaacacaaagc

SEQ ID NO: 3138 - RNA, 62 nt, Human
guacauuuucucccuuaggaauauacauagucuuuguuuacaugaguucaaauacuuuuggg

SEQ ID NO: 3139 - RNA, 61 nt, Human
guaccaaccucauagaguuuggugucaacuaaaugagauuauauguggacuaaauaucugu

SEQ ID NO: 3140 - RNA, 64 nt, Human
guaccacuuuauauuuucucuuccauagugagauguaugcaguauguggccauguuuacuaaca

SEQ ID NO: 3141 - RNA, 63 nt, Human
guaccgcaaggccuccuggauccaaagcaccaugucaguauuauuuguugguccuuuuugugc

SEQ ID NO: 3142 - RNA, 63 nt, Human
guaccuaauuagacaguucuccaaacacagaacacacacuggaaaauuuuccggccaauuuug

SEQ ID NO: 3143 - RNA, 64 nt, Human
guaccuacagcuaagcuuccacuuauaagugagaacaugcaguauuugguuuuccauuccugag

SEQ ID NO: 3144 - RNA, 62 nt, Human
guaccucucuuuugugacucuuguacagcuuaaugugcaauaaaggaaaaguuauaucugau

SEQ ID NO: 3145 - RNA, 61 nt, Human
guaccugcccucuauuuauuagccaacuguuucccugcugaaugccucgcucccuucaaga

SEQ ID NO: 3146 - RNA, 63 nt, Human
guaccuguaucaaaggaauuuuaacaaagagcaaucaguauuauuggaccaaauuugguguuu

SEQ ID NO: 3147 - RNA, 64 nt, Human
guacgaaaggguuugugccaauauucacuacguauuaugcaguauuuauaucuuuuguauguaa

SEQ ID NO: 3148 - RNA, 62 nt, Human
guacgacuaauguuggagccugaaacuauggaaaugcugcuaaaauuuuuauauugacaaac

SEQ ID NO: 3149 - RNA, 61 nt, Human
guacuauaacauauuggccacuaaaauucauauugagauuaucuugguuucuuggaagaga

SEQ ID NO: 3150 - RNA, 63 nt, Human
guacucaugucgcuucuccuuguguuacccccucccaguauuaccauuugccccucaccugcc

SEQ ID NO: 3151 - RNA, 64 nt, Human
guacuccuuaacuguucugaauuucuuucagagaaaaacuggaaaagacauuaaaucauguuga

SEQ ID NO: 3152 - RNA, 62 nt, Human
guacugaaaauugauauuauuuuccuuuucuuauaugaaggaccuuauuuggcauauaaaau

SEQ ID NO: 3153 - RNA, 62 nt, Human
guacugucuuugaauuuacuacuguaagacuaagcaguguuacuggacacaguuuuaacuug

SEQ ID NO: 3154 - RNA, 62 nt, Human
guacuuaguugaaacaaaaaggaauuuuaguagacaguauuauauuaucuuugaaaaucaag

SEQ ID NO: 3155 - RNA, 62 nt, Human
guacuuaguugaaacaaaaaggaguuuuaguagacaguauuauacuacauuugaaaaucaag

SEQ ID NO: 3156 - RNA, 61 nt, Human
guacuuuuucuuuucuagaggaaguaucuauucacugugaaaaucugaaaaauauaacaaa

SEQ ID NO: 3157 - RNA, 64 nt, Human
guacuuuuuguuuuuguuauaaaggaagacagaacaaacuggaauguuuuaugauguuguauag

SEQ ID NO: 3158 - RNA, 62 nt, Human
guagaagacuuuuaggaaaauaucagagaauuuaaugaaggaaagaagccuuggcaaaauga

SEQ ID NO: 3159 - RNA, 64 nt, Human
guagaaggauuuauuaugacccccuuuguuccaagcaugcaguaucauaagaacuggaaaaacu

SEQ ID NO: 3160 - RNA, 62 nt, Human
guagaauacagcagggccaaaacuagagugauacucaucucaggcacaaauauauaugggga

SEQ ID NO: 3161 - RNA, 64 nt, Human
guagaauagaaauguuugugaaauaaaacugauuuuaacuggaaggagaaacagguuaauggac

SEQ ID NO: 3162 - RNA, 64 nt, Human
guagacaguuggguuuuuuaagggcccuuuuucaauaacuggaacacucuauaacaaaggauac

SEQ ID NO: 3163 - RNA, 63 nt, Human
guagagagcuaaccauggagcacaguggcuggugggugacuuagucugaugguuuguggacca

SEQ ID NO: 3164 - RNA, 62 nt, Human
guagaugacucacuccagugaaauguuggguagcuguuuacaaccucacaggcauaauugau

SEQ ID NO: 3165 - RNA, 62 nt, Human
guagcauaacuuauaucuguauuuaaggacuuuugugcaauauggucuuaagaaauaauugc

SEQ ID NO: 3166 - RNA, 62 nt, Human
guagccagugagaaaagcagauagacugaagaauaugaaggauagcugagcuguagccucca

SEQ ID NO: 3167 - RNA, 62 nt, Human
guagcuugauaugguguuucagugcuuauugguugugcaauaaugguuauagccuguuagau

SEQ ID NO: 3168 - RNA, 62 nt, Human
guaggaaaaaugcaagccaucucuaauaauaagucaguguuaaaauuuuaguagguccgcua

SEQ ID NO: 3169 - RNA, 61 nt, Human
guaggcacuaaguuuuauuaggaaauauuuaaaccugcugaaggauuuauuuauaaaaagu

SEQ ID NO: 3170 - RNA, 63 nt, Human
guaggccacauaauuguaguauuuucaauaaagaugugacuuaauaguuaagguauucauaac

SEQ ID NO: 3171 - RNA, 62 nt, Human
guagggcccuggcccuucugauggaagcugggccucaucucaguagagggguagaauuaggg

SEQ ID NO: 3172 - RNA, 63 nt, Human
guaguaucaccuuuugccagaaggccuggcuggcugugacuuaccauagcagugacaauggca

SEQ ID NO: 3173 - RNA, 64 nt, Human
guagucuucagcuuuaggcagaugcaaaagaauacaaacuggaauauuaagaauacuguucaac

SEQ ID NO: 3174 - RNA, 62 nt, Human
guagugaauuaauuauucauuccauuccacuaucaugaaggacucugaauagacuuggccaa

SEQ ID NO: 3175 - RNA, 62 nt, Human
guagugcagaagguucacacugcaaauaguguucucaucucaaagcaaacuaucauuccaga

SEQ ID NO: 3176 - RNA, 62 nt, Human
guagugucagggauucuucgggaaggucaacaguaugaaggauucugaccccugugccuccc

SEQ ID NO: 3177 - RNA, 63 nt, Human
guagugugaauuaauccuuuugugcuguguuuaaucaguauuagcuuuauagaauuauauaug

SEQ ID NO: 3178 - RNA, 64 nt, Human
guaguucguugggggcaaaugaauuagccaacuguuaacuggaagcuuuugauaauuuuuuuuu

SEQ ID NO: 3179 - RNA, 63 nt, Human
guaguuuuaauuuagcucgguucucuuguuggugccaguauuacauugaagacuaccuaugau

SEQ ID NO: 3180 - RNA, 63 nt, Human
guauaaaauauaaggauuacuuuuguauguuccaacaguauuauacuuguuuuggcaucagca

SEQ ID NO: 3181 - RNA, 63 nt, Human
guauaaauuaugcagaguuauuuuccuauaucucacaguauuaaaaauaaauaauuaaaaauu

SEQ ID NO: 3182 - RNA, 63 nt, Human
guauaagcuauuucauaaaagcagcuuuaaauugucaguauuaagguuuucauguggaaaggu

SEQ ID NO: 3183 - RNA, 61 nt, Human
guauacauuguauguguuaaaaagaaauuugcaacugugaauaaaaggacuucuuuagaag

SEQ ID NO: 3184 - RNA, 64 nt, Human
guauacauuucuuuuuucuaucagauauucauugucaugcaguaguaguaaaaacaucaaagau

SEQ ID NO: 3185 - RNA, 62 nt, Human
guauaccagagaagguagauuuuaagaauggucucaguguuaauacugagaaaaaguccugu

SEQ ID NO: 3186 - RNA, 62 nt, Human
guauaguaguuaucuuaaaauauacacuccuaagcaguauuauuuuaaaauccuuuacccug

SEQ ID NO: 3187 - RNA, 61 nt, Human
guauauauauuauauauuaaauauauaauauauugagauuauaaaagaugaaaauauugaa

SEQ ID NO: 3188 - RNA, 62 nt, Human
guauauuauacauacacaaguuugugugaaagaugugcaauaacaaagguguauguauguuu

SEQ ID NO: 3189 - RNA, 64 nt, Human
guauauuauccuaugugaaaucaagggacagaaaauaacuggaaggaaauauuccaaaauguua

SEQ ID NO: 3190 - RNA, 63 nt, Human
guaucauaugguaucucucuagauuucaaggaaacacacuggauacugccuacugacaaaacc

SEQ ID NO: 3191 - RNA, 64 nt, Human
guauccaacugagccacuuuuaauuuaaaagucugaaacuggaauuaaguuuacuuucaaaaau

SEQ ID NO: 3192 - RNA, 62 nt, Human
guaucccucguuuaucauccccuuuguuugugauugcugcuaaagucaguaguaucguuuuu

SEQ ID NO: 3193 - RNA, 64 nt, Human
guauccuaugacugugcuacguauauauagguaauaaacuggaauucuguugaugaauauagcu

SEQ ID NO: 3194 - RNA, 63 nt, Human
guaugauugugaccuuuaacaaaaugcaaagguauacacuggaaagguacucagcaaaauucu

SEQ ID NO: 3195 - RNA, 62 nt, Human
guauggcuaguugagguuucagauuuauuccccauguuuacagauaccgcuaauaaauugca

SEQ ID NO: 3196 - RNA, 62 nt, Human
guauguacagucuacuuuugaacuauuuuuaucacaguauuauuuauugcuuucuuucaaua

SEQ ID NO: 3197 - RNA, 61 nt, Human
guauguuaaaaucaccauuucucaggucaaaauacugugaaucugcaguguccuugcugug

SEQ ID NO: 3198 - RNA, 62 nt, Human
guauuagcuagagaagacauugaugaagcaguaugugcaauauuauuuaaagaaaauuccau

SEQ ID NO: 3199 - RNA, 62 nt, Human
guauuccaagaaaaucaaagugguacaauuuguuuguuuacacuaugauacuuucuaaauaa

SEQ ID NO: 3200 - RNA, 63 nt, Human
guauucuaguuccguuugauaucaugaaaggacuuacacuggagugaaacccuaugaauguaa

SEQ ID NO: 3201 - RNA, 63 nt, Human
guauucuggaagcgugaauugcuuuugaagucugucaguauuacugguauuuuuaaauaaaga

SEQ ID NO: 3202 - RNA, 64 nt, Human
guauucuuuauaauugaauugguuuuucccacgucuaacuggaaacaaaacagaaggggcguca

SEQ ID NO: 3203 - RNA, 62 nt, Human
guauuuaugaacugugauaaagcaucaaaucuugaugaaggauuguagauuuuugcuuuuuc

SEQ ID NO: 3204 - RNA, 62 nt, Human
gucaaagagaauuaaaaaaaaaaacuucagauuuuguuuacauauuuuacuacauuuuugcu

SEQ ID NO: 3205 - RNA, 62 nt, Human
gucaaaggucacugucagucuuugcaccugcuuucaguguuauugugaaagguguacuuugu

SEQ ID NO: 3206 - RNA, 61 nt, Human
gucaacuacagcacugaaguuauaguaagugaaugagauuaucaguuuucaggguugguuu

SEQ ID NO: 3207 - RNA, 62 nt, Human
gucaagacuccugccaggaauggggggugcugagucaucucacgaagaaucccucacucuuc

SEQ ID NO: 3208 - RNA, 61 nt, Human
gucaagcugcuguagccuccuggccucagagccccugcugacccuggcacccagggaccug

SEQ ID NO: 3209 - RNA, 61 nt, Human
gucaaguacuuagcuaaaaucaacaaagugaggacugugaagauaacuuucauguaguugg

SEQ ID NO: 3210 - RNA, 62 nt, Human
gucacgaaggggguucucccagagugaagcuucuucaucucacucuagaguugcugaucccu

SEQ ID NO: 3211 - RNA, 62 nt, Human
gucacuugagaccggccaggaauguuugcaugaccuaccucaggaggggaggcgaggaagag

SEQ ID NO: 3212 - RNA, 64 nt, Human
gucacuugcaucuucacaaaggauaaaccacggagcaacuggaaaaccaucagccaagcguucg

SEQ ID NO: 3213 - RNA, 62 nt, Human
gucagaaucggugcuggaagacgaaguccccacagugcaauaaugagguucccacggaaaau

SEQ ID NO: 3214 - RNA, 62 nt, Human
gucagcuucucccaagcccacgucaggccuggccucaucucagacccugcuuaggauggggg

SEQ ID NO: 3215 - RNA, 64 nt, Human
gucagggaaugucauuacacucugauuuuuaaaauuaugcaguauuuuccaguucucagagagg

SEQ ID NO: 3216 - RNA, 62 nt, Human
gucaguauuuuuccagcauuuaaauugaaacggucaguauuagaccacugcuagguuaugua

SEQ ID NO: 3217 - RNA, 61 nt, Human
gucaguguuuguauuuguauucucugcaauuuuacugugaaaaaaaauuuguuuucaacaa

SEQ ID NO: 3218 - RNA, 62 nt, Human
gucauaggcuucugcacguuggaucaacuaauguuguuuacaauauagaugacauuuuaaaa

SEQ ID NO: 3219 - RNA, 64 nt, Human
gucaucacaacauacuccaucaucccaggacacugaaacuggaagaacugaccagaaauuugcc

SEQ ID NO: 3220 - RNA, 61 nt, Human
gucauccaagcugguuuugaacucccaaagugcugagauuacaggggugagccacugugcc

SEQ ID NO: 3221 - RNA, 62 nt, Human
gucauccagugacugcucauauuguggcauuaugcaguguuacaucuugccuugauacccag

SEQ ID NO: 3222 - RNA, 61 nt, Human
gucaucugcugauaauucggcgaugcuuaacaaccugcugaagucucaagaaagcagugga

SEQ ID NO: 3223 - RNA, 63 nt, Human
gucaugaacuuugagaaugggcuuccuuuuugguucaguauuagugagagggagagggagaug

SEQ ID NO: 3224 - RNA, 62 nt, Human
gucauguugggguuuuuaaugugauuguguauucuguuuacauuaaaaagaagcgcuguugg

SEQ ID NO: 3225 - RNA, 62 nt, Human
gucauucuguuuuaagcucauggaucaauggauuuguuuacaaugugauauuuucuauuaaa

SEQ ID NO: 3226 - RNA, 62 nt, Human
gucauugucuaaugauucgaugcgcuacagucuacaguguuagggauacuauuucauuuuag

SEQ ID NO: 3227 - RNA, 61 nt, Human
guccaaagauuuuuuauugcugcauuucacacaacugugaaccgaauaaauagcuccuauu

SEQ ID NO: 3228 - RNA, 62 nt, Human
guccaagacaggggccuaaggagggucuccacacugcugcuaggggcuguugcauuuuuuua

SEQ ID NO: 3229 - RNA, 63 nt, Human
guccaaguggacucuacagagugcuugaccucaacacacuggauuccagguggacuggaccaa

SEQ ID NO: 3230 - RNA, 63 nt, Human
guccauuugcuacugccuagucuugguuccuuaugcaguauuauagggcagccuuuuuagagc

SEQ ID NO: 3231 - RNA, 63 nt, Human
guccauuugugcagcauugacuuagagcuacaaaagugacuuaauguuauucuggaaauaaua

SEQ ID NO: 3232 - RNA, 64 nt, Human
guccccaaauggacauuugaauggacuaacaaaaacaacuggaaagacugaauuuccgacacaa

SEQ ID NO: 3233 - RNA, 64 nt, Human
guccccuaaacccaacucacguuucuguaugucuuaggccaguaucccaaaccucuuccacguc

SEQ ID NO: 3234 - RNA, 63 nt, Human
gucccucccagcagucccuccaccuccauaaggacacacuggacaaaacucccgcagcucuuc

SEQ ID NO: 3235 - RNA, 62 nt, Human
gucccugagguaucugagcguuuaaaguacugagcaguauuagcggaucccgcguaguguca

SEQ ID NO: 3236 - RNA, 62 nt, Human
gucccugguaauaaguacuguguacagaauucugcuaccucacugggguccuggggccucgg

SEQ ID NO: 3237 - RNA, 62 nt, Human
guccgauccuaaccguguaugcacccuacagcagcaguauuacucacuagccacagaauacc

SEQ ID NO: 3238 - RNA, 61 nt, Human
guccuauguaucaucauuuacucugggaauccuacugugaaaucaugucuguauuuuucug

SEQ ID NO: 3239 - RNA, 62 nt, Human
guccuggguaaggcuucauuugaaugaaggguucugcugcuaaaaaaaaaaaaaaagucgga

SEQ ID NO: 3240 - RNA, 61 nt, Human
guccugugguuauagcuagaaggacaggagucuccugcugaugcgugauagcuuaagcuug

SEQ ID NO: 3241 - RNA, 61 nt, Human
guccuguucugcccauggcccagcccggccgcuccugcugaccccuccuggacgggcugga

SEQ ID NO: 3242 - RNA, 63 nt, Human
guccuuuccuggcugugacccgccacacucacugucaguauuaaggcccagcagccuguugau

SEQ ID NO: 3243 - RNA, 63 nt, Human
gucgccuuugcagaaccaccugggccccuuucugucaguauuauuaggguuacgaauugcagc

SEQ ID NO: 3244 - RNA, 64 nt, Human
gucgggcggaccugagucgggcagccgcucucccggaacuggaagggaaagccaggcggcucuc

SEQ ID NO: 3245 - RNA, 63 nt, Human
gucguaggauguauacagacuuauuuucuuuauuacaguauuauaagaaaacauauguauuug

SEQ ID NO: 3246 - RNA, 62 nt, Human
gucuaaaacauuuaaauacucauucugaaguaacucaucucaaaauccaaugcuagaaaaau

SEQ ID NO: 3247 - RNA, 51 nt, Human
gucuaugaugcauuuauaaaacuaacuggaacugagaaauucucaugccca

SEQ ID NO: 3248 - RNA, 61 nt, Human
gucuauuucaucagaacagcuguugacucuaguacugugaauccagugaaaauaagccaug

SEQ ID NO: 3249 - RNA, 62 nt, Human
gucucaaaugucucguaucaguuuuaguguuuuucaguauuagggaaagguaauauaaaaac

SEQ ID NO: 3250 - RNA, 62 nt, Human
gucucauucuguaaaauggugauauuacuggaacucaucucauaggguuguuagugagugaa

SEQ ID NO: 3251 - RNA, 62 nt, Human
gucuccauauaauugauuauuaggauauauucccaugaaggauucuuuuuuuaaaaaaaugu

SEQ ID NO: 3252 - RNA, 62 nt, Human
gucuccccaagugaccauugguggagaccaauuaaugaaggaaugaaauucacuuuauuggg

SEQ ID NO: 3253 - RNA, 62 nt, Human
gucuccccacucccggcagcacuuuaggcagcccauaagcuaugcgagaaugugaacgcuca

SEQ ID NO: 3254 - RNA, 63 nt, Human
gucuccuuuagguuuucaagcacaugaaaguacucacacuggagauaaacccuuugaguguaa

SEQ ID NO: 3255 - RNA, 62 nt, Human
gucucugaaagcuguccuuucagaugagggagaaaugaaggauuucacacuucagaauauuu

SEQ ID NO: 3256 - RNA, 61 nt, Human
gucucugcuguauuccauguaucccaauccgguccugcugaucaauuccaaucccagacau

SEQ ID NO: 3257 - RNA, 62 nt, Human
gucugauuacuucaccaggaugauuucugagaucucaucucauaucguccugaauacacaca

SEQ ID NO: 3258 - RNA, 62 nt, Human
gucugcaaauuucaugaauuugugaugucuuugcuguuuacaugcagucccaagaaauggau

SEQ ID NO: 3259 - RNA, 62 nt, Human
gucugcuguugauuccacugaaaccucuguucucaugaaggagaggauuuggcucgcugugg

SEQ ID NO: 3260 - RNA, 64 nt, Human
gucuggagaaaaaacacacuguaauauuucaaguguaugcaguagaauguacuguaacugagcc

SEQ ID NO: 3261 - RNA, 62 nt, Human
gucuggggagagcagcacacuggccgcccagcacugcugcuaugacgaggacagccggcugc

SEQ ID NO: 3262 - RNA, 62 nt, Human
gucuguacuucuguuugaacuuuccacguuguccuguuuacaaguuaacuuaaguuggggua

SEQ ID NO: 3263 - RNA, 62 nt, Human
gucugucccacggcccacacgcucacuugacucaugcugcuaagaugcacaaccgcacaccc

SEQ ID NO: 3264 - RNA, 62 nt, Human
gucuuaugaugugugccucucccucccccaaaccuguuuacagucaauuauaaccugacaaa

SEQ ID NO: 3265 - RNA, 62 nt, Human
gucuuauggauaagguacaugaagauuuuugcagcaguauuagugguucaguggcugcacuu

SEQ ID NO: 3266 - RNA, 63 nt, Human
gucuucaccuuuuccuguauuuguacauagugauucaguauuagagaaaagugcauuguuucu

SEQ ID NO: 3267 - RNA, 64 nt, Human
acaaccaaguagagugacuuaagcugaacaguaacuaacuggaaaauuagauaagcaccuggca

SEQ ID NO: 3268 - RNA, 62 nt, Human
acaaccaguuugggugacagggcugguaaagucccaguguuagaugagugaccuaaauauac

SEQ ID NO: 3269 - RNA, 64 nt, Human
acaaccuguaaccacaaucccucaccucucagagggaacuggaacccuccuuucuccgugugac

SEQ ID NO: 3270 - RNA, 62 nt, Human
acaacuucacucuuucauaauauauaggauaaauuguuuacaugauuggacccucagauucu

SEQ ID NO: 3271 - RNA, 61 nt, Human
acaacuuggcaacuuccacuccuucucaccucgugagauuaagggcugugaaaagaaaucu

SEQ ID NO: 3272 - RNA, 63 nt, Human
acaagaguuugaacucaagggacugugaccccugcacacuggaguggcucauuguggcagguu

SEQ ID NO: 3273 - RNA, 62 nt, Human
acaagauguaggcuccagcuccccucagaccuccucaucucaugagcuucuuggggcuggcc

SEQ ID NO: 3274 - RNA, 63 nt, Human
acaagcagaccaacaacacugaggaagauagaguggugacuuagaauuaacucgugcuaaggg

SEQ ID NO: 3275 - RNA, 62 nt, Human
acaaggaaucaaugcugauauaaaacaucaauuaaugaaggaaguucgaaaguuuggucgaa

SEQ ID NO: 3276 - RNA, 63 nt, Human
acaagguuacuucaucuucauucauuauuaccugacaguauuaaacuacuacucaauaauuuu

SEQ ID NO: 3277 - RNA, 63 nt, Human
acaaguagcacugaguuucuuaggaaauuugucuucaguauuaggucuccaacucuuguaaaa

SEQ ID NO: 3278 - RNA, 62 nt, Human
acaagugcuucuaaaccuucaaagauggcaaaauuguuuacaccagugagagggagaucaaa

SEQ ID NO: 3279 - RNA, 62 nt, Human
acaaguucuucauucuuuaaaauguuuugacagaucaucucauaauaaaaauaauucaggaa

SEQ ID NO: 3280 - RNA, 62 nt, Human
acaauacaaagagauaaagcaauuucauauagugauaagcuagggaggagugcuaaaaggag

SEQ ID NO: 3281 - RNA, 62 nt, Human
acaauaccaugauuccuuccauuuucaacaguagaugaaggaaaugauacugaaugagucac

SEQ ID NO: 3282 - RNA, 62 nt, Human
acaauacgggcguggcuuuguuccaguaaaacuuuguuuacaaauguggugccauaguuugu

SEQ ID NO: 3283 - RNA, 62 nt, Human
acaauauauuuaauucaaguccaauccauguaaucaguauuaagaguguguuuuaccauuca

SEQ ID NO: 3284 - RNA, 64 nt, Human
acaaucauuguuuugaauauuacuccuauuuuuguaaacuggaauuaaaaggauaguauuuuua

SEQ ID NO: 3285 - RNA, 64 nt, Human
acaauguuuuguuuccuuuccuuuguuuuuucuuuuaacuggaauaauuaccauugaaaaagaa

SEQ ID NO: 3286 - RNA, 63 nt, Human
acaauuaagccgaccaggaaaccucauuccuaccuacacuggaaggagcgcucucacugugga

SEQ ID NO: 3287 - RNA, 62 nt, Human
acaauuauuauuaguggcuuuuuaaaaaaugaaacaguguuaagugaaauguaguuccuagc

SEQ ID NO: 3288 - RNA, 62 nt, Human
acaauuuuucuucuuuucuauauuacaagggccccaguguuaaugucuuagauuuucaguau

SEQ ID NO: 3289 - RNA, 62 nt, Human
acacaaaaugucucucuagaguugacuuuaaaguuguuuacagaaauuuaaacucaauucca

SEQ ID NO: 3290 - RNA, 61 nt, Human
acacaauccuccugccuuagccuccugaguaacugagauuacaggcacaagcugcugcacc

SEQ ID NO: 3291 - RNA, 62 nt, Human
acacaccugcuaguaucuccgcaaccuccaggcaucaucucagcugacagugacgccauccu

SEQ ID NO: 3292 - RNA, 62 nt, Human
acacacuugcaauugugucugguaugcuuguuccugcugcuaauaaaguaaggcccauuacu

SEQ ID NO: 3293 - RNA, 62 nt, Human
acacagccaaaaaaaaaaccacuaaguuagaucucuaccucacaguguccauacaaauuagu

SEQ ID NO: 3294 - RNA, 61 nt, Human
acacaggccuggggacaggaagggaugggggucccugcugaauauauagagaccucaacag

SEQ ID NO: 3295 - RNA, 61 nt, Human
acacaggccuggggacagggagggaugggagucccugcugaauaucuggagacccugacag

SEQ ID NO: 3296 - RNA, 62 nt, Human
acacagugagagucuuaaagauacaaaaugguauuguuuacauuacuagaaaauuauuaguu

SEQ ID NO: 3297 - RNA, 63 nt, Human
acacauaacauuguaugcauggaaacauggaggaacaguauuacaguguccuaccacucuaau

SEQ ID NO: 3298 - RNA, 64 nt, Human
acacauccagcaaauggugucccugcugaaacuuuuaacuggaaaccucacaccuggcaggcag

SEQ ID NO: 3299 - RNA, 61 nt, Human
acacauccugcauggcauucugugaagggcauaccugcugaggauaaugccaggagcagca

SEQ ID NO: 3300 - RNA, 61 nt, Human
acacaucuucauugugaaacccuuccccugugcugagauuaaaugaacucuaagauuauua

SEQ ID NO: 3301 - RNA, 62 nt, Human
acacauggggaucagagcagacuucuccacuacugugcaauagagauacagcucucuucaga

SEQ ID NO: 3302 - RNA, 63 nt, Human
acaccaaacucuugucuauauuuaccuuuguaccacaguauuaaucgcuauuguucauguauc

SEQ ID NO: 3303 - RNA, 64 nt, Human
acaccacaggguucauacuaaaauauguuuuugcagaugcaguaaaaaugaaaaaaauuuaauc

SEQ ID NO: 3304 - RNA, 64 nt, Human
acaccagaggguucauacugagauauauuuuugcagaugcaguauauauuuaaaacauuuaauc

SEQ ID NO: 3305 - RNA, 64 nt, Human
acaccaucagggaagcuuguuguaacggcuuuugaaggccaguaaccauuguugugguuguguu

SEQ ID NO: 3306 - RNA, 62 nt, Human
acacccuuaacuuucucuuuacccuuagcugaaauguuuacauagcuucuggugauaucuuu

SEQ ID NO: 3307 - RNA, 62 nt, Human
acaccuaccugcggucauauuguagagagaugcucaguguuaaaacugaaacacacaaacac

SEQ ID NO: 3308 - RNA, 62 nt, Human
acaccuguauuuccauggaaugguaucuuaguccugcugcuauaacaauaccugagacugaa

SEQ ID NO: 3309 - RNA, 62 nt, Human
acaccuuuuaacucaccucucaaggugggccuugcuaccucaagggggacugucuuucagau

SEQ ID NO: 3310 - RNA, 63 nt, Human
acacguacaggaaauauuauuucuuguaaaacauaacacuggaggagaugccuuaugacggag

SEQ ID NO: 3311 - RNA, 61 nt, Human
acacgucgugggguuccugucacgacuaucacuugagauuauauuauuauccucacucccu

SEQ ID NO: 3312 - RNA, 62 nt, Human
acacuaauuaacuaugggacuuaaaucuguagaaaugaaggaguccaauagcuucuuccaau

SEQ ID NO: 3313 - RNA, 51 nt, Human
acacuaccgcucccccugagggcccugcugauccgcaccccauuccucccc

SEQ ID NO: 3314 - RNA, 62 nt, Human
acacucaaggacuuuguucauuuccaaagcuacuuguuuacauuguacacugcgaccaccuu

SEQ ID NO: 3315 - RNA, 62 nt, Human
acacucugaauucuuacuugauggagguuuuguuugcugcuacgguuuuaaucauccagggu

SEQ ID NO: 3316 - RNA, 64 nt, Human
acacugaaccuuuugcugauguguuuaucaaaugauaacuggaagcugaggagaauaugccuca

SEQ ID NO: 3317 - RNA, 61 nt, Human
acacugaggcguggugugauuaaaugacuugucugagauuaguuuucaggcaugugaagga

SEQ ID NO: 3318 - RNA, 62 nt, Human
acacuggguuaugcucguuuuuuccuggagucagugcugcuagcuucauguugcucugcgac

SEQ ID NO: 3319 - RNA, 63 nt, Human
acacugugaauggcagacuuuucauuuagccccaggugacuuacuaaaaauaguugaaaauua

SEQ ID NO: 3320 - RNA, 63 nt, Human
acacuuucccaauuuauauuuuaaaaagcuaaagaacacuggauuaauaaucuuuugggaggg

SEQ ID NO: 3321 - RNA, 64 nt, Human
acagaaaaaagagcuagcccaaagcaguguugcuggaugcaguauucucuugcuaagaggaagg

SEQ ID NO: 3322 - RNA, 62 nt, Human
acagaaagucaucaaguaaacacugcaugucuaaucaucucagaguuguggcuguuaucucu

SEQ ID NO: 3323 - RNA, 62 nt, Human
acagaagugcauguccacugugcgggccaguguguguuuacacaaauuucaucucagcuuug

SEQ ID NO: 3324 - RNA, 62 nt, Human
acagaauuacagggaaguuacagggaagcagguuucaucucaauauugggagagauuucaaa

SEQ ID NO: 3325 - RNA, 62 nt, Human
acagaauugacugggacuaauaucacaggaucaaucaucucagaaucuuacuugaugcauua

SEQ ID NO: 3326 - RNA, 61 nt, Human
acagaauuucauucauuugugcuuuugcauuaaacugugaauguuccaacaccugccucca

SEQ ID NO: 3327 - RNA, 63 nt, Human
acagacagccaggauaaaguggcaccuucuggaguacacuggagggggcagcccaaguuagag

SEQ ID NO: 3328 - RNA, 61 nt, Human
acagacccaccaguaggaacugucacagaauggccugcugaacugggauguggaacugugg

SEQ ID NO: 3329 - RNA, 62 nt, Human
acagacugucacugaucacuuccauuccuguugcuguuuacacagaauggacuuuaaaaaaa

SEQ ID NO: 3330 - RNA, 64 nt, Human
acagacuuaaugaagguuuuaauuaccagaacuaaaaacuggaaauaacaguaccgugcaguca

SEQ ID NO: 3331 - RNA, 61 nt, Human
acagagaacauaaguugcaugccauagucacacacugugaaagugaaaagagaaugugugc

SEQ ID NO: 3332 - RNA, 62 nt, Human
acagagaugauggaugagcagcuggauuuucgugaugaaggacggaagcagcagcgggccgg

SEQ ID NO: 3333 - RNA, 61 nt, Human
acagaggaaacugacauuugucauguucacuuaccugcugauggaauccagcuucaagagc

SEQ ID NO: 3334 - RNA, 63 nt, Human
acagaugggcuguggccccugcaggcagcuguugaacacuggagggucccccggaccacacug

SEQ ID NO: 3335 - RNA, 61 nt, Human
acagaugguccuaguggagauggggaaugugucccugcugacuccucauaccccagaggac

SEQ ID NO: 3336 - RNA, 61 nt, Human
acagcauuuagcaaaccugauucagaaaacauuugagauuagcaaauuaguaacuauuggg

SEQ ID NO: 3337 - RNA, 64 nt, Human
acagccacaaacaaguacuuuaccccacagcuuaguggccaguaaacacccuggggacuaggaa

SEQ ID NO: 3338 - RNA, 64 nt, Human
acagcugcaguuagcacuguuaucugagcaugaaagaacuggaaacgcuccuuacgucgagaug

SEQ ID NO: 3339 - RNA, 62 nt, Human
acaggcagcguuuggaaaccuuuuauuauauaguuguuuacauacuuauaagucuaucauuu

SEQ ID NO: 3340 - RNA, 62 nt, Human
acaggcaucgcugcugagcuggggguccgcaucccuaccucagcuuaggacccccagagcca

SEQ ID NO: 3341 - RNA, 62 nt, Human
acaggccaaucagacagggcccagagcaucucuuugcugcuacuguuuugccauccuucuau

SEQ ID NO: 3342 - RNA, 62 nt, Human
acagggcugccucacccuuucauugccgagguuccuaccucauggacagaacaaacaccuca

SEQ ID NO: 3343 - RNA, 62 nt, Human
acagggcuuuauuguacuacugugaaguguaugugugcaauacauuggugaguucauuuacu

SEQ ID NO: 3344 - RNA, 62 nt, Human
acaguaaccuccaucaaaugcuauaccaauggaccaguguuaguagcugcucccuguauuau

SEQ ID NO: 3345 - RNA, 62 nt, Human
acaguaucuuacaaaaaacguguugcucucuucacaguauuauguguaaagucauuguuuaa

SEQ ID NO: 3346 - RNA, 61 nt, Human
acagucccuaaaagaggaaugccugcuggcuauugagauuauuguggcuuuuguauuucug

SEQ ID NO: 3347 - RNA, 63 nt, Human
acaguggguaccacgaucuccguaaccauuugcaugugacuuagcaagggcucugaaaugaca

SEQ ID NO: 3348 - RNA, 62 nt, Human
acaguguuaccagagcccaguaagaacugcugucaugaaggaggggccaccuuguaagagac

SEQ ID NO: 3349 - RNA, 61 nt, Human
acaguguuuucugaaggcgugugucaugauacaacugugaauucuaccuuagggacucugg

SEQ ID NO: 3350 - RNA, 61 nt, Human
acaguuuuuacuaauuaguuuaucaaaccaaauacugugaacguaccagguguuuacagau

SEQ ID NO: 3351 - RNA, 62 nt, Human
acauaaaaauauaguuuggaauucuuugcucuacuguuuacauugcagauugcuauaauuuc

SEQ ID NO: 3352 - RNA, 62 nt, Human
acauaaagcaaauuuggaggaaacaacugaaguugugcaauauuuucugauaauugcuuuuu

SEQ ID NO: 3353 - RNA, 63 nt, Human
acauaauuaaacuauuucugcuauuauuuuuaaagcaguauuauuuuauaaccaauucuaaaa

SEQ ID NO: 3354 - RNA, 64 nt, Human
acauacccacacaauuaauauaagggauauguuguuaacuggaaggguguaaagcagaaguucu

SEQ ID NO: 3355 - RNA, 62 nt, Human
acauacucaacugcuacuguucccuuugaggaaauguuuacaggggcggccuuuuaacauau

SEQ ID NO: 3356 - RNA, 64 nt, Human
acauacucaauuacuaacaagccccaagagugucugaacuggaacagucagggugcuuccucuc

SEQ ID NO: 3357 - RNA, 62 nt, Human
acauaguuagaagaauauauuuauaaagauuccuugcugcuaagucagaucagauuugcuaa

SEQ ID NO: 3358 - RNA, 64 nt, Human
acauaucuuaauugauuucucaacuauuuuauaaguaacuggaauuuuucauuagaucuuauac

SEQ ID NO: 3359 - RNA, 63 nt, Human
acauauuguggaauugacucaaaaaugagguacuucaguauuaaauuagauaucuucauagca

SEQ ID NO: 3360 - RNA, 62 nt, Human
acauauuuaaacuaauauucccuuacaauauggacaguauuaauccuuccaagaugcaguau

SEQ ID NO: 3361 - RNA, 63 nt, Human
acauauuuauuaagauuguauuauuggaaauguagacacuggacuaguaugccucauuaugag

SEQ ID NO: 3362 - RNA, 62 nt, Human
acaucacuaaaugugggcauagaaacuccacagcuguuuacaaauuugguuacagugugcua

SEQ ID NO: 3363 - RNA, 64 nt, Human
acaucagagaguucauacuaaaauauauuuuugcagaugcaguaaauaugaaaaauauuuaauc

SEQ ID NO: 3364 - RNA, 62 nt, Human
acaucaguauaacugcauuucuaguuucuauauagugcaauagagcauagauucuauaaauu

SEQ ID NO: 3365 - RNA, 64 nt, Human
acaucauauuguaauucuauucuuugcagcucaagcaugcaguaugaauacuguguauuuuuua

SEQ ID NO: 3366 - RNA, 62 nt, Human
acaucccagacagacagaugugaccaggacaaacgugcaauaaugccaaauguuaaaaugug

SEQ ID NO: 3367 - RNA, 61 nt, Human
acaucgguucaggaggagacagucaggaagccuccugcugagugguccacauucugcugcc

SEQ ID NO: 3368 - RNA, 61 nt, Human
acaucuacagcaaacaagaguuccaagagaaagacugugaaacagcaggcccacaggagcu

SEQ ID NO: 3369 - RNA, 61 nt, Human
acaucuguggccaucgcuggguccauuuuucugacugugaaguaaggagagacgucucagu

SEQ ID NO: 3370 - RNA, 61 nt, Human
acaugagagcuaauuuggaguacagacagacacccugcugaguagaauauaaaaguuaaug

SEQ ID NO: 3371 - RNA, 62 nt, Human
acaugcacaagcuaaacauaauuugaaugggucuaugaaggaaaaauaaugcuuagacuuug

SEQ ID NO: 3372 - RNA, 62 nt, Human
acauggcaauucauuauacccuccuauuuuccuauguuuacauuauucauuaauuaaaaaac

SEQ ID NO: 3373 - RNA, 63 nt, Human
acauggucuaauuuuaacauaaauaauaugccuucacacuggauuguaaaaggcaugugauuu

SEQ ID NO: 3374 - RNA, 62 nt, Human
acaugucuagucuguccuuuaauagcucucuuaaauaagcuaugauauuaaucagaucauua

SEQ ID NO: 3375 - RNA, 62 nt, Human
acauguucagguuuuuuuuuuuuuuuuuuuuucaauaagcuauuuuuuuucuuuucuuauuu

SEQ ID NO: 3376 - RNA, 62 nt, Human
acauuaaguauuuauugagcuucugucauaugcccaguauuaugcuucuucuauacuguuuc

SEQ ID NO: 3377 - RNA, 63 nt, Human
acauuauaagauaaauaaauuaaauuaaugaaaaugugacuuagaguagggguagcccucaaa

SEQ ID NO: 3378 - RNA, 62 nt, Human
acauucaccucuuauuuuauauugaaauguauuacaguauuaaaacucaguguucaguauuu

SEQ ID NO: 3379 - RNA, 62 nt, Human
acauucuggaauucugaacugcagcuagccugcugugcaauaguacaagugggaggacgucu

SEQ ID NO: 3380 - RNA, 62 nt, Human
acauugagcucaguggccuguuucaucacguaugugcugcuaccuguacagcagacaugccg

SEQ ID NO: 3381 - RNA, 62 nt, Human
acauuuguguuucaacaagggacaguaaacuguguguuuacagccaaaagaaaugccucaua

SEQ ID NO: 3382 - RNA, 62 nt, Human
acauuuugccaaaauuauuaauauaagaagcuuucaguauuagugaugucaucugucacuau

SEQ ID NO: 3383 - RNA, 61 nt, Human
acauuuugggaaguugcauuccuuugucuucaaacugugaagcauuuacagaaacgcaucc

SEQ ID NO: 3384 - RNA, 62 nt, Human
accaaaauuagccagguguguuggcacacgcccgucaucucagcuacucaggaggcugaggc

SEQ ID NO: 3385 - RNA, 64 nt, Human
accaaagagccccccgggucacccccgccccacugaggccaguagggggccaggccucccacuc

SEQ ID NO: 3386 - RNA, 61 nt, Human
accaaaggcaugguaccucagucugguauccagacugugaaaucagccucugggccaagga

SEQ ID NO: 3387 - RNA, 64 nt, Human
accaaaucuaaauacagaguagagcagacguauaagaacuggaaauaugaugacguaaaauuuu

SEQ ID NO: 3388 - RNA, 62 nt, Human
accaaaugacuugggauggugugcauagcaagggcaguguuacacuuaugaggacugucucu

SEQ ID NO: 3389 - RNA, 62 nt, Human
accaacaaccaaaccugucaugacagacagcaaauguuuacacguauauuucuccugaguga

SEQ ID NO: 3390 - RNA, 64 nt, Human
accaagaagacagccugaaauagcccgacaguucugaacuggaacaugggcauuggguucuaaa

SEQ ID NO: 3391 - RNA, 62 nt, Human
accaagauaaauugcaugcggcauggccccagccaugaaggaacuuaaccgcuagugccgag

SEQ ID NO: 3392 - RNA, 61 nt, Human
accaaucucuguugaaagaagccaggguuugccacugugaagcuugauuucugcuggugac

SEQ ID NO: 3393 - RNA, 64 nt, Human
accaauguaacuaagcauuuguguucugauaucugaggccaguaacuauuaauaucuaguucuc

SEQ ID NO: 3394 - RNA, 64 nt, Human
accaauguaacuaaguauuuguguucugauaucugaggccaguaacuauuaauaucuaguucuc

SEQ ID NO: 3395 - RNA, 64 nt, Human
accacaaaagcaguauaauaaaagguaaugaauaauaacuggaaaauucaaugccacaggaaua

SEQ ID NO: 3396 - RNA, 50 nt, Human
accacacccauacuuuugaggaaugaaggaaauucugagcaagauaagca

SEQ ID NO: 3397 - RNA, 62 nt, Human
accacauccccacaccccauugccacuuauuuauucaucucaggaaauaaagaaaggucuug

SEQ ID NO: 3398 - RNA, 62 nt, Human
accaccuuuaauauuacacugcuuauaauacuaauguuuacagauauguuucuguuuauaac

SEQ ID NO: 3399 - RNA, 61 nt, Human
accacgccacugaccagcuaucuggggaaguuuacugugaagggguuucugccuuuagcaa

SEQ ID NO: 3400 - RNA, 61 nt, Human
accacuuaagugacauaaauauuauagaaagguacugugaaaugaucacuuuguggcaggg

SEQ ID NO: 3401 - RNA, 63 nt, Human
accagaaaaccaucgccaacuccugcgaucagcuugugacuuacaaaccuuguuuaaaagcug

SEQ ID NO: 3402 - RNA, 62 nt, Human
accagacugaagcacauguaauauagaccguguauguuuacaauguuguguauaaaugggac

SEQ ID NO: 3403 - RNA, 61 nt, Human
accagauauggccaguugcgcagguuucugccaacugugaaguauccuccuggagcaguga

SEQ ID NO: 3404 - RNA, 64 nt, Human
accagaugauucacauguaggaaacagccagaagccaacuggaauuuugugugcuaacuguucc

SEQ ID NO: 3405 - RNA, 62 nt, Human
accagcagaucugccugugcacagacuuccuguacuaccucacuccugaggggagaugcuuc

SEQ ID NO: 3406 - RNA, 62 nt, Human
accagcagcccacaaaccagacugggcuaaguucugcugcuauuucuagagcuugcugcugu

SEQ ID NO: 3407 - RNA, 64 nt, Human
accagcuuuggcucgggagaguggggcugcuuguagaacuggaagugaauaacuuuuucaagca

SEQ ID NO: 3408 - RNA, 62 nt, Human
accaggacucugggccccuccccagcuccacucccuaccucaagaaugugaccauuuggaaa

SEQ ID NO: 3409 - RNA, 63 nt, Human
accaggagacgauaaaaguagaaaguuggagucaaacacuggaugcagaaauuuuggauuuuu

SEQ ID NO: 3410 - RNA, 63 nt, Human
accaggguccuucccugccccacuuccccuuuucccaguauuacugaauagucccagcuggag

SEQ ID NO: 3411 - RNA, 62 nt, Human
accagugaaagacagaucauaggagagacccuuuugcugcuacuucauucguucugaccuaa

SEQ ID NO: 3412 - RNA, 62 nt, Human
accaguggggacccacacccuggcugggcagaggugcugcuagcaaccucucuuccucuaua

SEQ ID NO: 3413 - RNA, 64 nt, Human
accaguguaacuaagcauuuguguucugauaucugaggccaguaacuauuaauaucuaguucuc

SEQ ID NO: 3414 - RNA, 62 nt, Human
accaguuauuuaaccuguaaaaugucaauagcaaaugaaggaugaaguauaucucuagaugc

SEQ ID NO: 3415 - RNA, 63 nt, Human
accaguugacuuuuauucauuagauacagaaggugcaguauuacacaucaccagcugccuuug

SEQ ID NO: 3416 - RNA, 62 nt, Human
accaguuucacacccccuuuccaucuguuugauacaguauuauagauauaaauauauauaua

SEQ ID NO: 3417 - RNA, 62 nt, Human
accaucaauagaauuaaggucaaaaaccgcauggucaucucaauagacaaagaaagggcauu

SEQ ID NO: 3418 - RNA, 63 nt, Human
accaugaaaguuuacaguccgggacugugacccuaacacuggaguuccagaugaggaugggua

SEQ ID NO: 3419 - RNA, 61 nt, Human
accaugccgaucucugagaaguuauguugcaccacugugaaggucuagaugcaagcuuggc

SEQ ID NO: 3420 - RNA, 62 nt, Human
accaugguuuuccugaaauccucaauucaucaauaugaaggaaaugaaccacauagacuuua

SEQ ID NO: 3421 - RNA, 61 nt, Human
accauguaccugcuuuggcaaucauugcaacucugagauuauaaaaugccuuagagaauau

SEQ ID NO: 3422 - RNA, 62 nt, Human
accauugacuucauuuguacuuaguuauguuggucaguguuagaggaugcauuuuggguuca

SEQ ID NO: 3423 - RNA, 62 nt, Human
accauuggcuugccaagaguacagaaauucauuaugcugcuaauuuaacguggaauuccuuc

SEQ ID NO: 3424 - RNA, 62 nt, Human
accauuuaaagaaagaaugcauuccagaacaaauuguuuacauaaguuccuauaccuuacug

SEQ ID NO: 3425 - RNA, 62 nt, Human
accauuuaauaguuauaacgucguuacuuguacuaugaaggaaaauacucagugucagcuug

SEQ ID NO: 3426 - RNA, 61 nt, Human
acccaaaagcccccaaaguggcacuucugaguuccugcugauguuacaagggaccacacuu

SEQ ID NO: 3427 - RNA, 64 nt, Human
acccaauuucugcuuccaaccauuauccauagaaacaacuggaaguugagaagugcagucuuuu

SEQ ID NO: 3428 - RNA, 62 nt, Human
acccacacacaccaccaucucacugggucuagucucaucucagacaacccccacccccacug

SEQ ID NO: 3429 - RNA, 64 nt, Human
acccagaacacacacguuuucccuacagcagaggccaugcaguauuauauauucauuuugcaga

SEQ ID NO: 3430 - RNA, 62 nt, Human
acccagaggaagccucuauuuauuuauuagcuuuuguuuacaccguggaauugaccccuucc

SEQ ID NO: 3431 - RNA, 61 nt, Human
acccagccugguacugaaggugccagacgugcuccugcugaccuucugcggcuccgggcug

SEQ ID NO: 3432 - RNA, 64 nt, Human
acccagcgucgacccuugacccacgaagugcguagcaugcaguauuuaaagcaguguagcuacg

SEQ ID NO: 3433 - RNA, 62 nt, Human
acccaggaaaggugugaggcuggaagcacugaaccuaccucauccuccuggaggguguggcu

SEQ ID NO: 3434 - RNA, 62 nt, Human
acccaggauaaaggacauccggauagguguguuuaugaaggauggggccuggaaaggcaacu

SEQ ID NO: 3435 - RNA, 63 nt, Human
acccagggucuagccgcugcccuggguccugccugcaguauuacagaggucgucgaaaggugc

SEQ ID NO: 3436 - RNA, 64 nt, Human
acccaguagccccauuucauacaauguaccuaaauuaugcaguaacuuggcaucaucguucccu

SEQ ID NO: 3437 - RNA, 64 nt, Human
acccaucuuccaaccccggcuauuuggagacggaaaaacuggaauucuaacaaggaggagagga

SEQ ID NO: 3438 - RNA, 63 nt, Human
accccaagccccuuccuccauuuauguuuacaguugugacuuagguauucacugucuuccucc

SEQ ID NO: 3439 - RNA, 63 nt, Human
accccagagagauaaaauacauguauaguguuuuucaguauuacacauugauuuaaaaagauu

SEQ ID NO: 3440 - RNA, 62 nt, Human
accccagcugccacuccucuaguugaaaguguuguguuuacaucugacauuaaauuauuuuu

SEQ ID NO: 3441 - RNA, 63 nt, Human
acccccaccaccaggcuucuauuugggauucacaucaguauuaguaucguagcuacaccaagu

SEQ ID NO: 3442 - RNA, 63 nt, Human
accccuaaagaugcaacccuuaaagauacaguguucaguauuauugaaauaugggcaucugca

SEQ ID NO: 3443 - RNA, 61 nt, Human
accccuccuccuagguucaagcgauugaguagcugagauuacaggcaugcaucacuaugcc

SEQ ID NO: 3444 - RNA, 62 nt, Human
accccuuuuacacuuuucagauucucaaagugucucaucucaacuuuuaaaagaauaaagaa

SEQ ID NO: 3445 - RNA, 61 nt, Human
acccgaggggcagccaggaaaggcgaucucuucacugugaaaaguugcccgggugcagcgc

SEQ ID NO: 3446 - RNA, 62 nt, Human
acccgcuuuugugcugccugcaagcuaagacuaauguuuacauuuuuaaaugguuggaggaa

SEQ ID NO: 3447 - RNA, 62 nt, Human
acccuagagauucucuguaauauugguaauuuggaugaaggaagcuagaagaauuacaggga

SEQ ID NO: 3448 - RNA, 63 nt, Human
acccuagugauuuuuggauaaggaucacuacugaacaguauuaggcaacuuuucauuuuugcu

SEQ ID NO: 3449 - RNA, 63 nt, Human
acccucccaggauucaaagcuagguuuggcugucugugacuuacgggaccguccugcugagaa

SEQ ID NO: 3450 - RNA, 62 nt, Human
acccuuaugagaagugaagguuuuguaaacuuuccaguauuaauuugggcggguauuccccg

SEQ ID NO: 3451 - RNA, 62 nt, Human
acccuugcucuccaauuaggcccacguggcauuucaguauuauuaagucagggaaggagccc

SEQ ID NO: 3452 - RNA, 62 nt, Human
acccuuuuucauuauuucauuugcucucauauaucaguauuauuuuugagcauuuuguuaca

SEQ ID NO: 3453 - RNA, 64 nt, Human
accgaauagguugugugaugaaauucugugucuuggaacuggaauugaguuucgauguugauga

SEQ ID NO: 3454 - RNA, 62 nt, Human
accgaggacagauucaaauaacaauuaauggauucaguauuagcaauggacuggcaacuacu

SEQ ID NO: 3455 - RNA, 62 nt, Human
accgaggcacccccccgucccccagaaucuuggcuguuuacaaaucacguguccaucgagca

SEQ ID NO: 3456 - RNA, 61 nt, Human
accgcugacugcaccagcgcccccagaacauacacugugaacucaaucuccagggcuccaa

SEQ ID NO: 3457 - RNA, 62 nt, Human
accggaacuuguugaugaacuuguuuucaaaauaucaucucaucaacgaggccuggacaaac

SEQ ID NO: 3458 - RNA, 62 nt, Human
accguaugucccacaaugccuaaaacauugacuauguuuacagaaaaaguuugcugaccccu

SEQ ID NO: 3459 - RNA, 62 nt, Human
accguauuuucuaggacaagaguucucagucacugugcaauaugcccccugggucccaggag

SEQ ID NO: 3460 - RNA, 62 nt, Human
accgugugaggcacucccccuccccaccccaucucaguguuaacugacugcugacuuggagu

SEQ ID NO: 3461 - RNA, 61 nt, Human
accuagcaaagcuccugccucuuugugugcgucacugugaaacccccacccuucugccucg

SEQ ID NO: 3462 - RNA, 63 nt, Human
accuagggugcaaacagauggacuaugguucaaggacacuggaauugaggagcugaucaaggc

SEQ ID NO: 3463 - RNA, 62 nt, Human
accuauuuuuaaugaaacuucaaauagcaauaaguuccguuauauacuguggccugaaauaa

SEQ ID NO: 3464 - RNA, 62 nt, Human
accucggucuggaucuccccaccaccagcagccugugcaauauuuauuggucuaucaauuuc

SEQ ID NO: 3465 - RNA, 63 nt, Human
accucucccuaugugagguuuguaaaaaguguccugugacuuaacacagaaacgcaauaaaca

SEQ ID NO: 3466 - RNA, 63 nt, Human
accucuccugcuguccccgcgugcacaagucucuuacacuggacgcccacugcuccucagcgu

SEQ ID NO: 3467 - RNA, 62 nt, Human
accugcaggcacguguguaugcacuccccgcuuguguuuacacaagcugugggguguuacgc

SEQ ID NO: 3468 - RNA, 63 nt, Human
accugcucaggauuugaaauacguuuaauuuucaggugacuuaagacagcuaugauugaauca

SEQ ID NO: 3469 - RNA, 64 nt, Human
accuggcugucuuuaucauccccacaaacauuuugaaacuggaauauuugucuucagaaaaugg

SEQ ID NO: 3470 - RNA, 61 nt, Human
accugggggcucacagcacagaaccuagaagcaccugcugacacucuucaacugauuuuua

SEQ ID NO: 3471 - RNA, 62 nt, Human
accugugaaauaacuauuuugacugaaauguaaaauaagcuauucaacaaagaacauauuaa

SEQ ID NO: 3472 - RNA, 62 nt, Human
accuuagguuuauuaaaggcuagguuuauuugggcaguauuagaaacaaaaucauggaucaa

SEQ ID NO: 3473 - RNA, 63 nt, Human
accuuaguuugauucuauuuuuuagcuugcaaaaagugacuuauauuccaaagaaauuaaaau

SEQ ID NO: 3474 - RNA, 62 nt, Human
accuucaagcugugauaugaguaaguucuacagauguuuacacaaguguugccaucuuugaa

SEQ ID NO: 3475 - RNA, 61 nt, Human
accuucaucaggggguggccaggaggggcccagacugugaauccugugcucugcccgugac

SEQ ID NO: 3476 - RNA, 62 nt, Human
accuuccauuacauaccuaauccuagcugucuccucaucucauccuagucuagguuugcuug

SEQ ID NO: 3477 - RNA, 62 nt, Human
accuucucagugguuuacaugccucugaaacuaugugcaauauuuuugguugacacuuguau

SEQ ID NO: 3478 - RNA, 62 nt, Human
accuuuaaguucaaggaagaacaagauauauacuucaucucaaaagaaucuacucacacaca

SEQ ID NO: 3479 - RNA, 64 nt, Human
accuuucucuuggccggauguccucagggcuggcagaugcaguagacugcaguggacagucccc

SEQ ID NO: 3480 - RNA, 64 nt, Human
acgaacagagggugcccuuggccaauguaguuaagaaacuggaaaaugguuucuucauguuuuc

SEQ ID NO: 3481 - RNA, 62 nt, Human
acgaaguuaagaucaaccacauaaaacauuucaugugcaauaagcucucaaucaaguaaaua

SEQ ID NO: 3482 - RNA, 64 nt, Human
acgacaguggcaccaccugauuucaugauguaccauaugcaguaacccauguuugagguacaga

SEQ ID NO: 3483 - RNA, 62 nt, Human
acgaggaaaagaccuuccccugaaccccuaaaaauguuuacagucucugcugguucccucug

SEQ ID NO: 3484 - RNA, 61 nt, Human
acgagugauuggcacugaaggggcuggggaaacccugcugagaccuuccaaggacagccgu

SEQ ID NO: 3485 - RNA, 61 nt, Human
acgauaggaauagcuuuuauuuuugauagaccaacugugaaccuacaagacgucuuggaca

SEQ ID NO: 3486 - RNA, 63 nt, Human
acgcaugcaggcauguaaauauuugucuggagucacaguauuaaugaaugagaucuuaagcau

SEQ ID NO: 3487 - RNA, 62 nt, Human
acgccgcuuacucagagcccuggccucccucccccuaccucacacgcugcucaugaaaguuu

SEQ ID NO: 3488 - RNA, 61 nt, Human
acgcgcacggugaagaggacgcccgagcccaccccugcugacccaggacuuccccaaccuc

SEQ ID NO: 3489 - RNA, 62 nt, Human
acgcuguccaauagaaaaaguuggugugcuggagcuaccucaccucagcuugagagagccag

SEQ ID NO: 3490 - RNA, 62 nt, Human
acggaacaaguuuaguagcaguaauaguaaaucauguuuacauaugagauuuauagucgugg

SEQ ID NO: 3491 - RNA, 62 nt, Human
acggaauuccuguccagaucuguuuauucuuuuacaguauuaaaugauuuucacuaauauau

SEQ ID NO: 3492 - RNA, 61 nt, Human
acggauggugaggggcugagaaugagggcaccgacugugaagcuggggcaucgaugaccca

SEQ ID NO: 3493 - RNA, 61 nt, Human
acggauuuguuacugaaaaacaaaaaaaucacuacugugaauuuacuacuauguaaccuug

SEQ ID NO: 3494 - RNA, 62 nt, Human
acggcagccuugcccucccuggcucaagcagucuucaucucagccuccagaguagcugggac

SEQ ID NO: 3495 - RNA, 64 nt, Human
acggcugugacuugauucaaaagaaaauguuauaagaugcaguaaacuaauaacagaauuauua

SEQ ID NO: 3496 - RNA, 63 nt, Human
acgggcagccaccauccuggccucaccuccacccaacacuggaacuccagcacccccagcuac

SEQ ID NO: 3497 - RNA, 62 nt, Human
acgguuaacauuuagcagaaaaacaaaccauugaauaagcuacuaggugaaaugcaaaacaa

SEQ ID NO: 3498 - RNA, 64 nt, Human
acgguucacacguggcuaugaucacaagcaacuuugaacuggaaugcuauuuacaaaaguuuug

SEQ ID NO: 3499 - RNA, 61 nt, Human
acgguuggaguggggaucggccugcgaaaggauacugugaaaucacuaauuaacuaauaaa

SEQ ID NO: 3500 - RNA, 63 nt, Human
acguaaauuauaguauuuggauggagcaaagucagcaguauuaaugguugaauauuaaugguu

SEQ ID NO: 3501 - RNA, 62 nt, Human
acguaguaguuuguaaaaacguuuucuaugacgcauaagcuagcaugccuaugauuuauuuc

SEQ ID NO: 3502 - RNA, 62 nt, Human
acguaucccugugcuggcaccugcucccugugcucaguauuaauuacgcccccuuaacuguc

SEQ ID NO: 3503 - RNA, 62 nt, Human
acgucuccuccauagccccgggaccguguugcuccaguauuaaccucuguggguggccugca

SEQ ID NO: 3504 - RNA, 62 nt, Human
acgucugugagggaccccagggaccggccugcaccuaccucagacccucauccuuggagagg

SEQ ID NO: 3505 - RNA, 63 nt, Human
acgugauucacaccuggcacaacauauuguaauucacacuggagagaaaccuuacaaguguaa

SEQ ID NO: 3506 - RNA, 62 nt, Human
acgugcugcagcccuccugucccuuccccccagucaguauuacccugugaagccccuucccu

SEQ ID NO: 3507 - RNA, 63 nt, Human
acguggaaaacgucggcugcucgugagaaucaugugugacuuacguuccuuauguuuuaugga

SEQ ID NO: 3508 - RNA, 63 nt, Human
acgugguugucugcuuuccuaaggacucccauuuccaguauuaaagagagaaucaucaucaag

SEQ ID NO: 3509 - RNA, 62 nt, Human
acguuagacucagauggaaaaguauucuaggugccaguguuaggaugucaguuuuacaaaau

SEQ ID NO: 3510 - RNA, 62 nt, Human
acguuuuuguuuuuuuaauguuaaauguguaacucaguauuacugaaaagguacccacauuu

SEQ ID NO: 3511 - RNA, 64 nt, Human
acuaaaaauauccuugaaagaauaguagcaaacaguaugcaguacuccuguguucuaaguucuu

SEQ ID NO: 3512 - RNA, 63 nt, Human
acuaaacaaagaugguuguucgggguuugggauugacacuggaggcagauaguugcaaaguua

SEQ ID NO: 3513 - RNA, 63 nt, Human
acuaagaucguugaagagcaauagaaccuuuaagacaguauuaaaggugugaaacaauggccc

SEQ ID NO: 3514 - RNA, 64 nt, Human
acuaagcauuuuguucacaccacgcuuugauaacuaaacuggaaaacaaagguguuaaguaccu

SEQ ID NO: 3515 - RNA, 62 nt, Human
acuaauuuauaacuuguucuauauuguaaauagcuguuuacagguuuuuaaauuuaaauuca

SEQ ID NO: 3516 - RNA, 62 nt, Human
acuacacuuuaucuuaauucuuaauuuaaaaacauguuuacaaguuacaaccaacuucuaug

SEQ ID NO: 3517 - RNA, 61 nt, Human
acuaccuuccccagagcuugccagguuggguuuugagauuagggucaggucauggguaugu

SEQ ID NO: 3518 - RNA, 62 nt, Human
acuagaaucuacucugcuuacauucuuguuuaaguguuuacacaguuugguucaauuauaaa

SEQ ID NO: 3519 - RNA, 63 nt, Human
acuagacaaucaucagugcagucucacagaaggcaacacuggaagugaugucauaagguugug

SEQ ID NO: 3520 - RNA, 62 nt, Human
acuagcuaauucucauauccaugccuuuuuguccuguuuacagucuuaaaagagguaaaaca

SEQ ID NO: 3521 - RNA, 62 nt, Human
acuaguggaaaguuacucuagcuuuuuaaaaggcuguuuacaauucuguguaaaaauagagc

SEQ ID NO: 3522 - RNA, 61 nt, Human
acuaguggcauuaacuuuuagaauuugggcuggugagauuaauuuuuuuuaauaucccagc

SEQ ID NO: 3523 - RNA, 61 nt, Human
acuauaaaaacaguggaaccacagcccuaaaguccugcugauauaaaguccuuuugucuua

SEQ ID NO: 3524 - RNA, 62 nt, Human
acuauaugaugaauagcacuaauacccacugcuucaguguuaacacagcagugauugucagc

SEQ ID NO: 3525 - RNA, 62 nt, Human
acuaucaguacacaaaugcaugaguauguuuauacaguguuagacugaugugaauuugcauu

SEQ ID NO: 3526 - RNA, 62 nt, Human
acuaucauagauauauuucaaauauuguacuacucaguguuaaguauugaaugacuguuucc

SEQ ID NO: 3527 - RNA, 62 nt, Human
acuaugcaauaauauaacuuagaguuccacgguuuguuuacacauuuccuguuguacauuua

SEQ ID NO: 3528 - RNA, 62 nt, Human
acuaugucagagccacauucccgucacauuauaaaugaaggaguggauucuuaaauaagacc

SEQ ID NO: 3529 - RNA, 61 nt, Human
acuauugaaccuggaacuggcuuugaccaugaaacugugaauggcccuaacuucaagggaa

SEQ ID NO: 3530 - RNA, 62 nt, Human
acuauuucaaaauguccagauguaggggaagagauguuuacaguaugaugaaaauaauuuuc

SEQ ID NO: 3531 - RNA, 62 nt, Human
acuauuugcacacgacagauuucuagauacuuuuugcugcuaguuuuauguaauauuuauug

SEQ ID NO: 3532 - RNA, 62 nt, Human
acucaaagugauauuuguacaccaguguuuguagcaguauuauucacaauagccaaaaggug

SEQ ID NO: 3533 - RNA, 61 nt, Human
acucacccuucagaaacagaccaaaggccaaaaccugcugauuuuucuauugaaaauaugu

SEQ ID NO: 3534 - RNA, 60 nt, Human
acucacuuccucuuuauaaaaugagucacuauacugugaagaaaaagacuuuuccuagaa

SEQ ID NO: 3535 - RNA, 63 nt, Human
acucagaaauaugaccucagugagugucaaaguuuacacuggaaaauaacuuuaaggugacag

SEQ ID NO: 3536 - RNA, 61 nt, Human
acucagugaaauaaacaagagcccccagucagaacugugaaacagggaaauuuuggggugg

SEQ ID NO: 3537 - RNA, 62 nt, Human
acuccaaguauucagaagugcuuguugaacaaaacaguguuaucuuuaauucauuccuuuuc

SEQ ID NO: 3538 - RNA, 64 nt, Human
acuccagguucguauagaaaaagcacagcucucacuggccaguagcugccaaaaagaacaccca

SEQ ID NO: 3539 - RNA, 62 nt, Human
acuccagugucuuugucaccaggcccuuuggacucuaccucagaaauauuucuuggaccuuc

SEQ ID NO: 3540 - RNA, 62 nt, Human
acucccuauuuucauuccuuuuuuaaaaaauaauauaagcuacagaaaccagguaagcccuu

SEQ ID NO: 3541 - RNA, 62 nt, Human
acucccuucccucugggcagaggcccaucugcucuguuuacacaccuggaccuggugugaag

SEQ ID NO: 3542 - RNA, 62 nt, Human
acuccuagccacagcugccaugauaaguccuuccaugaaggacugaggagggagaguggggg

SEQ ID NO: 3543 - RNA, 62 nt, Human
acuccugaauuuaauuuccccaccuaagucgaaacaguauuaucaaaacacaugugcacaca

SEQ ID NO: 3544 - RNA, 61 nt, Human
acuccuggcauugcccaccagggggcuggugcaccugcugaccucagggucacaguugagu

SEQ ID NO: 3545 - RNA, 62 nt, Human
acuccuucauuuuuccuucucccuucccuuuggacaguguuacagugaacacuuagcauccu

SEQ ID NO: 3546 - RNA, 61 nt, Human
acuccuugaaguguugcaagggaaccuccuagcacugugaaagucagaaucgccucagcau

SEQ ID NO: 3547 - RNA, 63 nt, Human
acucggccccucccuccccagcagccccaagcuuuacacuggaugcagcgaucaacccaccac

SEQ ID NO: 3548 - RNA, 62 nt, Human
acucgguccaaaaucagccaggccaucuuuuccaucaucucacuucaaauaaacauaauaau

SEQ ID NO: 3549 - RNA, 62 nt, Human
acucuaaccugcaccucccggguucaagugauucucaucucagccucccaaguagugugaac

SEQ ID NO: 3550 - RNA, 61 nt, Human
acucuaauaauguuucuuaaugguauagccuccugagauuaaauguaaaaucaaaaauuag

SEQ ID NO: 3551 - RNA, 62 nt, Human
acucugauaaucccauaaaacaaaguuuuaagaauguuuacaguaaccaugaauggaauuag

SEQ ID NO: 3552 - RNA, 62 nt, Human
acucugcauacccucaucaaaaacacucucacuaugcugcuauggacgaccuccagcucuca

SEQ ID NO: 3553 - RNA, 62 nt, Human
acucugcccaaaagcagcagacauguaagcagaugugcaauaaaaaaugaucuugauccauu

SEQ ID NO: 3554 - RNA, 61 nt, Human
acucugcccauguucccagggccucaucuguacacugugaaauuaacuggcauccuggugg

SEQ ID NO: 3555 - RNA, 61 nt, Human
acucugcggauagcauuugguagguagugauuaacugugaauaauaaauacacaaugaauu

SEQ ID NO: 3556 - RNA, 63 nt, Human
acucuggcaaaccugugagugauuccacaaagauacaguauuacuuagcuaucugaauuauga

SEQ ID NO: 3557 - RNA, 64 nt, Human
acucugguuacccaacuacagaaccuccuuugaucaggccaguagguugugaugcaggcuggag

SEQ ID NO: 3558 - RNA, 62 nt, Human
acucuuccuuucuggccaaggaugaugucaguucugcugcuacuagccuggaguugcagaag

SEQ ID NO: 3559 - RNA, 62 nt, Human
acucuugauauccgucuggcugugugaggcaccccuaccucaugggggugucuugggauuga

SEQ ID NO: 3560 - RNA, 61 nt, Human
acucuuggaaagaagccuuaugugaaagugaugacugugaaguaauauggcccacacuuua

SEQ ID NO: 3561 - RNA, 62 nt, Human
acucuuuccacaguguucagauuuguccuguguguguuuacaguauucaauuuauugcaguu

SEQ ID NO: 3562 - RNA, 62 nt, Human
acucuuuuuuuucuucgcuguauugaaacugguucaguguuaaccaggcaagcauaguuauu

SEQ ID NO: 3563 - RNA, 64 nt, Human
acugaaaguggccgggcccagacaugccccuuccaaaacuggaacaccuagcuaacaggagaga

SEQ ID NO: 3564 - RNA, 64 nt, Human
acugaacaagcaaaagcuggaagcauuccccuugagaacuggaaaaugacagggaugaccacuc

SEQ ID NO: 3565 - RNA, 64 nt, Human
acugaaggaaauuuaaacaaagaaacacuugaaagaaacuggaaagaaaaauaauuuuuuuaug

SEQ ID NO: 3566 - RNA, 62 nt, Human
acugaaggacuagaugaggcaaauaaagacuaguugcugcuauuccccagcugccaggagga

SEQ ID NO: 3567 - RNA, 61 nt, Human
acugaaugaaaaaaucauuacuauucuguauauacugugaagcuaguaaauugagacauaa

SEQ ID NO: 3568 - RNA, 61 nt, Human
acugaccuaguggacaagcugaauuugaaauagacugugaaguaagcuguaacuugucauu

SEQ ID NO: 3569 - RNA, 63 nt, Human
acugagagugggagacagaggcaggaacagggaugacacuggaggacagcaggccugccugga

SEQ ID NO: 3570 - RNA, 62 nt, Human
acugaggcagaugacaugaugaaaggaacagaaacaguguuauuagguuggaggacaccgac

SEQ ID NO: 3571 - RNA, 64 nt, Human
acugaggcccugcagcuaccaggugggcuagaagguaacuggaacaggccugggcacuugugca

SEQ ID NO: 3572 - RNA, 64 nt, Human
acugagguuuuccuuuaggaaaacucccgagggccaaacuggaaacauaagagugacugcucgg

SEQ ID NO: 3573 - RNA, 61 nt, Human
acugaucagacuuuaaagaaauuacuuuguaaaccugcugacuaccuguauguauuguaua

SEQ ID NO: 3574 - RNA, 64 nt, Human
acugaucuuucugggauagagguucuuuuuuaucuuggccaguauauuaugacuaaacgauuau

SEQ ID NO: 3575 - RNA, 62 nt, Human
acugauggugcauuuuauucuugaagugaaaucugugcaauaaaauaacagacugucugcag

SEQ ID NO: 3576 - RNA, 61 nt, Human
acugcacugacuuuauaucuuuugaauauaauuacugugaaaguauaaaggcuguguucug

SEQ ID NO: 3577 - RNA, 62 nt, Human
acugcagacuacugcuuugaaugaguugaauuacauaagcuaagaucacuauagguccauuu

SEQ ID NO: 3578 - RNA, 62 nt, Human
acugcagagcagcccugugacuuuacaaaauaugcuaccucaaagugcuaccgauaaaccuu

SEQ ID NO: 3579 - RNA, 62 nt, Human
acugcauauggcacaauguuuaauauuggcaaguucaucucagagaaaggggauucagauau

SEQ ID NO: 3580 - RNA, 61 nt, Human
acugcccccagcagcgcagucugggguauuuccccugcugaggagugacagggcuggagac

SEQ ID NO: 3581 - RNA, 64 nt, Human
acuggaaaaagaccaggaggccugcacuagggcaaaggccaguaggaauagauuggagguguua

SEQ ID NO: 3582 - RNA, 61 nt, Human
acuggacugggaaugaggaagacuggggcucuaccugcugaaccuaccccagacuugcugc

SEQ ID NO: 3583 - RNA, 61 nt, Human
acuggagccagccccacccuaggcaggaagaccccugcugagggcccccccgugcaguccg

SEQ ID NO: 3584 - RNA, 61 nt, Human
acuggagccugucaucugccccuuccguguuggugagauuaagggaagaaggugggagggc

SEQ ID NO: 3585 - RNA, 62 nt, Human
acuggagugauugugcuucuagauguggcaaauccaguguuaacacauauuucuggcugaga

SEQ ID NO: 3586 - RNA, 62 nt, Human
acuggaucaaguucagccaccgaauugcuuuuaucaguguuaaaguggucugaacugcuugc

SEQ ID NO: 3587 - RNA, 62 nt, Human
acuggauuucugugucuucacuagaacaccauugucaucucauauugaucagguauuuuaau

SEQ ID NO: 3588 - RNA, 62 nt, Human
acuggauuugguugaccuuuguggaacacaaauaaugaaggagcagaacauugacaagcuaa

SEQ ID NO: 3589 - RNA, 62 nt, Human
acuggccuuguucuccuuagcccgucacuccauacaguauuaggugaggauggaugcgggcg

SEQ ID NO: 3590 - RNA, 64 nt, Human
acuggcuaauaggaauucccuccuggugccaccacuggccaguaccuuuccuaagucuuugcuc

SEQ ID NO: 3591 - RNA, 62 nt, Human
acuguacauuucauucagaauaauaaauacuuauugcugcuaaaacuucuuaaaugguuguu

SEQ ID NO: 3592 - RNA, 62 nt, Human
acuguaggaagucaaaaacuuguacuguaucuuguguuuacaguucugauuuauuccuuuga

SEQ ID NO: 3593 - RNA, 61 nt, Human
acuguauguugcuucuuccuaggaaccccuuauccugcugaaguuuucuucuagucuucua

SEQ ID NO: 3594 - RNA, 62 nt, Human
acugucauuguacuaauuaauguacuaaauccuauguuuacauuaauaugugaaaaaagauu

SEQ ID NO: 3595 - RNA, 61 nt, Human
acugucgaauggccccacggaggggacgggcggccugcugagugaagccacaaauaccgag

SEQ ID NO: 3596 - RNA, 62 nt, Human
acugucucaacugugcaaaaaacaaaagauggaguguuuacaaguagacauucgucaucagu

SEQ ID NO: 3597 - RNA, 63 nt, Human
acugucucucuuuauacauccuuguaugguucucccaguauuagcaagauuguauaucuguaa

SEQ ID NO: 3598 - RNA, 63 nt, Human
acugugaagaugacccaaaguuuccaacuccuuuacaguauuaccgggacuaugaacuaaaag

SEQ ID NO: 3599 - RNA, 61 nt, Human
acuguggcccagcaggugacugguucuucaggaacugugaagguggugguuguggacucgg

SEQ ID NO: 3600 - RNA, 63 nt, Human
acuguguuuuauuaauaaucuucauaagaaaagaaacacuggauacuuuuuuguuguugauuc

SEQ ID NO: 3601 - RNA, 62 nt, Human
acuguuacaaugguagcagaaaauccuauugauuucaucucacccauuucagauaccuucag

SEQ ID NO: 3602 - RNA, 61 nt, Human
acuguucauguuucauuuugcaaccauugguuuugagauuaucuuuuaugcacauuuggag

SEQ ID NO: 3603 - RNA, 61 nt, Human
acuguugaguggcuuccucgguuuacucuguguacugugaaaguauuuucauauuuuuucu

SEQ ID NO: 3604 - RNA, 62 nt, Human
acuguugcuuugguagagaugagaggccgcauuuugcugcuaaagcaagagaaacuuggagc

SEQ ID NO: 3605 - RNA, 63 nt, Human
acuguuguuuuuugaagugccaaucccaugccaugcaguauuaugucccucuccuaucugugu

SEQ ID NO: 3606 - RNA, 62 nt, Human
acuuaaagaaaauaccuggaagaaaaccagacgaaugaaggauuuuggcauagaacauuucu

SEQ ID NO: 3607 - RNA, 63 nt, Human
acuuaaaugccuaccucugugcugaagcugacagacaguauuaacucuuaucaaggccaucuu

SEQ ID NO: 3608 - RNA, 62 nt, Human
acuuauauuaauaguaauuuguaaaguugguuggauaagcuauccguguugcagguucaugg

SEQ ID NO: 3609 - RNA, 64 nt, Human
acuuauuauuaugugaauaucuuguauuauuauacaaugcaguauucaaauuuguccuuguagu

SEQ ID NO: 3610 - RNA, 62 nt, Human
acuuauuguacucuguguacaguaaguauuuuuauguuuacacuuaccagauucauaagguu

SEQ ID NO: 3611 - RNA, 62 nt, Human
acuucaaggggucaaagggcaaccagcuugggugcuaccucaguguuguaguuucugauacu

SEQ ID NO: 3612 - RNA, 63 nt, Human
acuucaaugggacacuuuagaccauuagacaauugacacuggauuaaacaaauucacauaaug

SEQ ID NO: 3613 - RNA, 49 nt, Human
acuucagccacaacaguaaaaaacuggaagagauggauuuaaagaagaa

SEQ ID NO: 3614 - RNA, 64 nt, Human
acuucagguauaccucacuuuacacaauagaauuauaacuggaaagaaguuggggacacaugua

SEQ ID NO: 3615 - RNA, 62 nt, Human
acuucauuccagcagcugcaccccagcgucaggccuaccucaaguucuuggaccaguuugca

SEQ ID NO: 3616 - RNA, 62 nt, Human
acuucccccaaacugauuauagguaacaguuuaaucaucucacuugcuaacauguuuuuauu

SEQ ID NO: 3617 - RNA, 63 nt, Human
acuuccuuccccagcucaccuggaacacccuggauacacuggagugggaaaaugcugggacca

SEQ ID NO: 3618 - RNA, 64 nt, Human
acuucuaaaaaaaagauuuuuaaacacuuaaugggaaacuggaauuguuaauaauugcuccuaa

SEQ ID NO: 3619 - RNA, 63 nt, Human
acuucuuauuuuuuugaaaagacaauuuuccauuucaguauuacauuuuaccaagaagucacu

SEQ ID NO: 3620 - RNA, 62 nt, Human
acuucuucagaacauauucugacuuuagaugacacaguguuaggaaugacgaagguaaggaa

SEQ ID NO: 3621 - RNA, 61 nt, Human
acuucuucuucaguaaacuuugacucaacuucuccugcugaaaagaagcucgcuccagaug

SEQ ID NO: 3622 - RNA, 61 nt, Human
acuugaaccugggaggcagagguugcagugagcugagauuacaccacugcacuccagccug

SEQ ID NO: 3623 - RNA, 61 nt, Human
acuugaaccugggaggcggagguugcagugagcugagauuacaccccuggacuccagcuug

SEQ ID NO: 3624 - RNA, 62 nt, Human
acuugaauuccgucaucaaugcucaccgucaauauguuuacaaguuguagcaguugggggaa

SEQ ID NO: 3625 - RNA, 62 nt, Human
acuugagucguaagccuucuugcuuuugauaacacaguauuauuucucuuacuguagaagaa

SEQ ID NO: 3626 - RNA, 62 nt, Human
acuugggaugagugaaaaaauuacaucauuggacaugaaggaguuucaacauccagcuucau

SEQ ID NO: 3627 - RNA, 59 nt, Human
acuuggucggagccugugaccauuuguugacacugugaacuguccaaaagucucuuaac

SEQ ID NO: 3628 - RNA, 62 nt, Human
acuugguuaauagaaucuacuaucuggaagauaaaugaaggauuuuaauaaaauuuucaaua

SEQ ID NO: 3629 - RNA, 62 nt, Human
acuuguaugugcggagucacacugcagugccgaacaguauuagcucccguucccaagugugg

SEQ ID NO: 3630 - RNA, 62 nt, Human
acuugugcuguaccaaaaugguaauuauaacagacaguauuagaauuacugaauuaacaaug

SEQ ID NO: 3631 - RNA, 62 nt, Human
acuuguuaggaaguagcuuaauuaccccccauugcaguauuauuguuauauauauaguuaau

SEQ ID NO: 3632 - RNA, 62 nt, Human
acuuuaaccaacauuuacguaaguacggucuuugcaguauuacacaauaccgcaugagcuaa

SEQ ID NO: 3633 - RNA, 61 nt, Human
acuuuaauaaaggaucuuaaaaugggcaggaggacugugaacaagacacccuaauaauggg

SEQ ID NO: 3634 - RNA, 62 nt, Human
acuuuacuggcaagagacuuccuuugauuucuacuguuuacaaauaaaacucagccagucuc

SEQ ID NO: 3635 - RNA, 63 nt, Human
acuuuagcuacagcauuuccuauacccagagcuaaacacuggaauaauacugacaucauuuaa

SEQ ID NO: 3636 - RNA, 62 nt, Human
acuuuauaugaaaaugaauauuuuacaguuugcacaguauuauuuuacagaaaaggaaucag

SEQ ID NO: 3637 - RNA, 62 nt, Human
acuuuaucaggaugaacccaggacugcuucugaaugcugcuacuugauuucuuucucauccc

SEQ ID NO: 3638 - RNA, 64 nt, Human
acuuucccccuuuaauugaaggcauuguuuuguuagaugcaguaaugauguuuaccagagauua

SEQ ID NO: 3639 - RNA, 62 nt, Human
acuuuccccuugcucguuucucccuuguuguaaguguuuacaacuggcaugugcuuuuaaac

SEQ ID NO: 3640 - RNA, 62 nt, Human
acuuugaaauggugaauuucgugguaugugaauucuaccucaaucaaaaaaauuugcuauuu

SEQ ID NO: 3641 - RNA, 62 nt, Human
acuuuggcaaaaagugaacacaauucaaauacgaaugaaggaagagcccucagauggaacga

SEQ ID NO: 3642 - RNA, 62 nt, Human
acuuugugguauguuuugcuuuccuaauagggacaugaaggaaacccagcaauuugcuguua

SEQ ID NO: 3643 - RNA, 61 nt, Human
acuuuguguucuacugaguaagaugacuuguugacugugaaagugaauuuucuugcugugu

SEQ ID NO: 3644 - RNA, 63 nt, Human
acuuuuaugauaguuauuccaaauucaagaagaagcaguauuaacaucaauugaucgacacaa

SEQ ID NO: 3645 - RNA, 62 nt, Human
acuuuuauuaauucuucauuuuuuguaaaacuuauguuuacaagaagaaaacaaaucaaaac

SEQ ID NO: 3646 - RNA, 62 nt, Human
acuuuuauuuuuuaaacaaugggcuaaaaauaaacaguauuaaaagguuaaguuuauauaau

SEQ ID NO: 3647 - RNA, 62 nt, Human
acuuuugggaucaggugccugaucacugggcccccuaccucagccccccuuucccuggagca

SEQ ID NO: 3648 - RNA, 61 nt, Human
acuuuuuuguaaugcuguuuaacucucaaucagacugugaacuggauggucacgaagucau

SEQ ID NO: 3649 - RNA, 64 nt, Human
agaaaaaagauggaacuuuuccaauucaguuuuugaggccaguacaaccuugauaacaaaaccu

SEQ ID NO: 3650 - RNA, 62 nt, Human
agaaaagaagaaagaaugaaguaacaaacaaagaaugaaggaagaaaaaauuuuuacaaaca

SEQ ID NO: 3651 - RNA, 62 nt, Human
agaaaaguaaccucuucuuaaguggaauauucuaauaagcuaccuuuuguaagugccauguu

SEQ ID NO: 3652 - RNA, 61 nt, Human
agaaaauacagugugugugugugcaccugugugccugcugaacaacuugacaguguaacag

SEQ ID NO: 3653 - RNA, 62 nt, Human
agaaaaucaguuucuagaagccgcuguuaccucuuguuuacaguuuauauauauaugauaga

SEQ ID NO: 3654 - RNA, 62 nt, Human
agaaaaucugugcuagaaccugugucuuauuccuauaagcuauguguucagacugaaacugg

SEQ ID NO: 3655 - RNA, 64 nt, Human
agaaaaucuucuuuacucugcauguuuuuaaugguaaacuggaaucccagauaugguugcacaa

SEQ ID NO: 3656 - RNA, 64 nt, Human
agaaaauguuugccauuuuugcauuguuucguuuuuaacuggaacauuuagaaagaaggaaaug

SEQ ID NO: 3657 - RNA, 64 nt, Human
agaaacacucuguacugugugcggacccgcagugacggccaguaaaguggacuuaacucccaag

SEQ ID NO: 3658 - RNA, 62 nt, Human
agaaacaguuucaacucugaaagugaauuucacgucaucucaguagccacgcuaguccauuc

SEQ ID NO: 3659 - RNA, 62 nt, Human
agaaaccacugucucuagaagaaagcuuguuuugcaguauuagugaaucacugaauagcuua

SEQ ID NO: 3660 - RNA, 63 nt, Human
agaaaccauuuuaccuacauaggcaaaguaaaugugugacuuagagacugccagauuuauggu

SEQ ID NO: 3661 - RNA, 64 nt, Human
agaaaccucaaacaaguagaaacuugccuagacaauaacuggaaaaacaaaugcaauauacaug

SEQ ID NO: 3662 - RNA, 61 nt, Human
agaaagauccuguuuagugaugacccagcucuaccugcugaauggaccugcaggguaaacu

SEQ ID NO: 3663 - RNA, 64 nt, Human
agaaagcuuugaauacuaaauuauaguguagaaaagaacuggaaaccaggaacucuggaguuca

SEQ ID NO: 3664 - RNA, 64 nt, Human
agaaaggugagacccucucccaagaggagcagagaaaacuggaagaagauuugcugguagaagu

SEQ ID NO: 3665 - RNA, 64 nt, Human
agaaaguacugauuaucucccaaaugagaagucauuaacuggaaaucucccuagaauacuuuca

SEQ ID NO: 3666 - RNA, 61 nt, Human
agaaauaaccaaccaggaacugcuuuuucuuuuccugcugaguacugcuaauaaaagugcu

SEQ ID NO: 3667 - RNA, 61 nt, Human
agaaauaugguauauguuuauaagaaucuuuuaugagauuauagauuucaaugcuguggau

SEQ ID NO: 3668 - RNA, 62 nt, Human
agaaauggaauuuauauacaaaaauauuuuccauuuccguuauuaugcuaauuguuguauga

SEQ ID NO: 3669 - RNA, 64 nt, Human
agaaauugaacacauugcuucaacuuauaucccacuggccaguacuuagucacguggcuacauc

SEQ ID NO: 3670 - RNA, 63 nt, Human
agaaauuguaucuuaguugguaucaaccaaauggagugacuuaguguacaugaaagcguaaag

SEQ ID NO: 3671 - RNA, 62 nt, Human
agaacaaucaugaaauggaagaaggaggaagagcaugaaggaucuuauaagaaaugcaagag

SEQ ID NO: 3672 - RNA, 63 nt, Human
agaacacacacguuuucccuacagcagaggccaugcaguauuauauauucauuuugcagaauc

SEQ ID NO: 3673 - RNA, 63 nt, Human
agaacaggaagcggucaugaaagugccauggaugaacacuggagguggcagugccuguuuaug

SEQ ID NO: 3674 - RNA, 62 nt, Human
agaacauaaaagaaagagaaucucagaaguaguuugcugcuaauauauacauauauuguaua

SEQ ID NO: 3675 - RNA, 62 nt, Human
agaacaucuagggaucuagcaaagcgagagauacaugaaggacauaaaaacguuuuuagaaa

SEQ ID NO: 3676 - RNA, 62 nt, Human
agaaccaaguuuuucuaugauauuaaaaaauguacaguguuagguauuauuugaauggaaag

SEQ ID NO: 3677 - RNA, 63 nt, Human
agaaccuagcugagccacuccugaccuacaaaguugugacuuaauaaaugugugcuuuaagcu

SEQ ID NO: 3678 - RNA, 62 nt, Human
agaacuggaagcuuggaggaaagcauacuggagaauaagcuacaaagagccugggcuuaaga

SEQ ID NO: 3679 - RNA, 62 nt, Human
agaacuuauauggagaaaccccuaggaauguaaucaguguuaggaugccucagccugaacuc

SEQ ID NO: 3680 - RNA, 61 nt, Human
agaacuuguuaaccuuucuaaccuucacgauuaacugugaaauguacgucauuugugcaag

SEQ ID NO: 3681 - RNA, 62 nt, Human
agaagaaagcuauaccauuaccauaauacauuuuucaucucauggcuacaauggaauucuug

SEQ ID NO: 3682 - RNA, 62 nt, Human
agaagaagauagugaggucauugaaccuccuucucuaccucagcuucagaccccccuggcca

SEQ ID NO: 3683 - RNA, 62 nt, Human
agaagacauagaacguugaaacagaaacagaaggaugaaggacaguuuuuuccuucuuaguu

SEQ ID NO: 3684 - RNA, 64 nt, Human
agaagaccagaugcuucacagaauuaucauuuuuucaacuggaauaaaacaccagguuuguuug

SEQ ID NO: 3685 - RNA, 62 nt, Human
agaagacuuuuuuuauuuuaaccaaaguuacuguuguuuacagugaguuuggggaaaaaaaa

SEQ ID NO: 3686 - RNA, 61 nt, Human
agaagagcugcuccccacucaugccccagagggacugugaaaaggcuuccugugaccuccg

SEQ ID NO: 3687 - RNA, 62 nt, Human
agaagauuaggaugacuaaauuaauggggaaaugaugaaggaguuugaaucucuucuuugug

SEQ ID NO: 3688 - RNA, 64 nt, Human
agaagauuuaugucagcacacacuuacagagcacaaaugcaguauauaggugcuggauguaugu

SEQ ID NO: 3689 - RNA, 62 nt, Human
agaagcgguuaucuuucuuuuuuacuuugcacaucaguguuagccuuucccuauuucagcac

SEQ ID NO: 3690 - RNA, 62 nt, Human
agaagcuacauuuuugcccuuaagacacuacuuacaguguuaugacuuguauacacauauau

SEQ ID NO: 3691 - RNA, 62 nt, Human
agaagcuauuugcagacuacagaaugggagaaaauguuuacaaacugcaucugacaaagauc

SEQ ID NO: 3692 - RNA, 62 nt, Human
agaagcuguacaaguauaggcagaguuauuuuccuguuuacauuuuuuuuuuguuuugggga

SEQ ID NO: 3693 - RNA, 64 nt, Human
agaaggcucuugaaauuuugucccuggagccucucuaacuggaaguagcaguucaucucaugac

SEQ ID NO: 3694 - RNA, 63 nt, Human
agaagggaauauauuggguuuuaaaaaaguguauugugacuuaaacuguuauaaguuauccuu

SEQ ID NO: 3695 - RNA, 62 nt, Human
agaagggacuuaauuacaaacuuaagacguaagugugcaauaaaguaagcuaagcaggcaug

SEQ ID NO: 3696 - RNA, 62 nt, Human
agaaggggcguuuguuuuauucuugguguuuucagugcaauaaauagcuacaaacuucugug

SEQ ID NO: 3697 - RNA, 62 nt, Human
agaaggguguaaacauuuuguuaauaaaaugcuauguuuacaaaucgaaccucagccucuca

SEQ ID NO: 3698 - RNA, 62 nt, Human
agaaggguuccaugagauuauuguagacucaugaugcugcuaucucaaccagaugcccagga

SEQ ID NO: 3699 - RNA, 62 nt, Human
agaagugguuauagaggcaucuuuguuuuguuuaucaucucagaguaaaggacugcaauguu

SEQ ID NO: 3700 - RNA, 62 nt, Human
agaaguguagagcuuacucuuggaguaccaaacugugcaauauuuuuacaucauaagaugua

SEQ ID NO: 3701 - RNA, 62 nt, Human
agaaguucauauuuugugacaucugcauugauuucaguauuacugaugguacuguuauucau

SEQ ID NO: 3702 - RNA, 64 nt, Human
agaaguuucugaagucuucacagcucuuaaaagccaggccaguacugacuguguggugguaaau

SEQ ID NO: 3703 - RNA, 64 nt, Human
agaauacaaaggguauacucuguuggaugcaccagaaacuggaaacugggaccaguggcagaga

SEQ ID NO: 3704 - RNA, 62 nt, Human
agaauaggaugggauaaagaaaguggacacuuaaauaagcuauaaauuauaugguccuuguc

SEQ ID NO: 3705 - RNA, 61 nt, Human
agaaucaauucuucaacucaagaugucugauuuacugugaauuugcccaaucuuugaugac

SEQ ID NO: 3706 - RNA, 63 nt, Human
agaaucagaggcuaaaaauauuaccccauauguuccaguauuagucauggauugcaaaggcuu

SEQ ID NO: 3707 - RNA, 64 nt, Human
agaauccaauaagcacauauugagcacuugcuguauaugcaguauugagcacuguaggcaagag

SEQ ID NO: 3708 - RNA, 62 nt, Human
agaaucugggaagagaaauggagaauaagcagcacaguguuauucauuucuguaaauuccua

SEQ ID NO: 3709 - RNA, 62 nt, Human
agaaugcacauauguagacgauuaaguguauauuauaagcuauaugcugaaaauggcuucca

SEQ ID NO: 3710 - RNA, 62 nt, Human
agaaugcauguucugugugcccugaaaauguuaccaguguuaauaaauggauacuuaucugu

SEQ ID NO: 3711 - RNA, 62 nt, Human
agaauguguaauagcucacaauaaguagguauuauguuuacauauuauguuuguauuuaugc

SEQ ID NO: 3712 - RNA, 62 nt, Human
agaauucaguguaguuuauacauuucgauuccuuucaucucagcaaaaugggcacugccaga

SEQ ID NO: 3713 - RNA, 62 nt, Human
agaauucuaagaugaauuuaccaggugagaaugaauaagcuaugcaagguauuuuguaauau

SEQ ID NO: 3714 - RNA, 63 nt, Human
agaauugcugugcaaggcucacccucucucugucaacacuggaauaaacuuugccuuuucugc

SEQ ID NO: 3715 - RNA, 62 nt, Human
agaauuuuuuuuuuuuuuuuuuuuuuuuggcaaauguuuacauucaauuaaggggaaaaagu

SEQ ID NO: 3716 - RNA, 62 nt, Human
agacaaaauuuuucuuuucuugauuuuuuuaaacauaagcuaaaucauauuaguauuaauac

SEQ ID NO: 3717 - RNA, 62 nt, Human
agacaaagucccgugcccuguuuccaaugccaauucaucucagcaaucacaagccaaggucu

SEQ ID NO: 3718 - RNA, 64 nt, Human
agacaaaguuugccaaccauaagugucaaaagcacaggccaguauuaagcagaaguucuaccac

SEQ ID NO: 3719 - RNA, 62 nt, Human
agacaagcgugucuuucuauaaaaaguauugaaaaugaaggaaaugagaucauguuucaauu

SEQ ID NO: 3720 - RNA, 64 nt, Human
agacaauaggggaagauauaacaaaagccaaaauuuaugcaguaaagaaaaaauuggggaagaa

SEQ ID NO: 3721 - RNA, 63 nt, Human
agacacccuuuuaaaguaauaugucuucaaauguugugacuuacauaaaguagcucuuucauu

SEQ ID NO: 3722 - RNA, 62 nt, Human
agacagcuguugaucuuguugcagaacugcacugaugaaggagagcgggaagcuauccagaa

SEQ ID NO: 3723 - RNA, 62 nt, Human
agacagguauuuuuucuucaugccugcucuagucucaucucauaucuuuaauucauucagca

SEQ ID NO: 3724 - RNA, 62 nt, Human
agacauaaggcacacagacguggaaaugauuaucaugaaggaagaaguuugugcucauagag

SEQ ID NO: 3725 - RNA, 64 nt, Human
agacauacucauuaaguguuauuuauuuuacucaagaacuggaaaccaacuaaaugccuucuau

SEQ ID NO: 3726 - RNA, 64 nt, Human
agacaucccaccaaagcuaacuuucccccaccccugaugcaguaaaacauugaaaaaaaaaaaa

SEQ ID NO: 3727 - RNA, 62 nt, Human
agacauuguucaacuguauguuauuggcacguguuguuuacauuuugcugugacauuuaaaa

SEQ ID NO: 3728 - RNA, 62 nt, Human
agacauuuccgaaccaaaggcugcuggguuugcauguuuacagacucccccuggggcgaggg

SEQ ID NO: 3729 - RNA, 61 nt, Human
agaccaggcuuuguuguccugcucugaguauccugagauuaaacugaauugcugaaugccg

SEQ ID NO: 3730 - RNA, 62 nt, Human
agaccauucgcgauuuagaaguuguggagggaagugcugcuagauuugacugcaagauugaa

SEQ ID NO: 3731 - RNA, 62 nt, Human
agaccauugucuugcaggacuacauuauaaauuuauaagcuaagugaguuggguuuucgaac

SEQ ID NO: 3732 - RNA, 62 nt, Human
agaccuaucuaaaauucagagcauaucaucugggcuaccucagggucaccacccauguauug

SEQ ID NO: 3733 - RNA, 61 nt, Human
agaccuaugaugacuugucccuuugaugucacuacugugaauugaauauaauuaguaaaaa

SEQ ID NO: 3734 - RNA, 62 nt, Human
agacgcuugguuuuucucagaacccccaaaagaugugcaauagcuguuguuacaaaccacca

SEQ ID NO: 3735 - RNA, 61 nt, Human
agacggggaagacuggcagggaggcacgcagguacugugaaaauccuucccuuugcccucc

SEQ ID NO: 3736 - RNA, 61 nt, Human
agacgucaggagauugagaccauccuggcuaacacugugaaacccugccucuacuaaaaau

SEQ ID NO: 3737 - RNA, 63 nt, Human
agacgugagacugacauaugccauuaucucuuuuccaguauuaaacacucauaugcuuauggc

SEQ ID NO: 3738 - RNA, 62 nt, Human
agacucagugccaugcagaagccuuuuuuuuaagaugaaggaaauauuuuauguaaagagca

SEQ ID NO: 3739 - RNA, 62 nt, Human
agacuccaacggagggagccuguugguguuaaauuguuuacauuucuuuauacaaauaaugu

SEQ ID NO: 3740 - RNA, 64 nt, Human
agacucuuuuuguaaauguauuuuguauuuaaugaaaugcaguauaaagguuggugaaguguaa

SEQ ID NO: 3741 - RNA, 62 nt, Human
agacuguaagauuuggguuuuguuuuguauuuuauguuuacaugcaucuuauauuucccuga

SEQ ID NO: 3742 - RNA, 62 nt, Human
agacuguauuuagaucucauaaugcuuuguuaaauguuuacaaguaaauaguuugaauucag

SEQ ID NO: 3743 - RNA, 62 nt, Human
agacuuagucauacaaagaaacuuagcucuuuuuucaucucacaguaaagccuauuucccca

SEQ ID NO: 3744 - RNA, 62 nt, Human
agacuuccucuaggaguggugcugcuaccuuguauguuuacauaaugcuuuagcccaaggac

SEQ ID NO: 3745 - RNA, 64 nt, Human
agagaaaaaccaguguaacguuuaugugacuguuugaacuggaaggucugggguuccggggggu

SEQ ID NO: 3746 - RNA, 64 nt, Human
agagaaagucacauuuaggguuuauuuuuuacacuuggccaguaaaauaggguaaauccuauua

SEQ ID NO: 3747 - RNA, 62 nt, Human
agagaaaugugucaucaggagaacaucauaacccaugaaggauaaaagccccaaaugguggu

SEQ ID NO: 3748 - RNA, 62 nt, Human
agagaacacuggcuucacagaggacuuugugcauugcugcuaugaacuuugaccugagucgg

SEQ ID NO: 3749 - RNA, 62 nt, Human
agagaagaaaucaguaucugaguugcauaccaggcaguauuaaaaucuaacaggucuguuug

SEQ ID NO: 3750 - RNA, 61 nt, Human
agagaagaauuccuagaacuuaugcauuuuuuuccugcugaauggaagucuugagcaauga

SEQ ID NO: 3751 - RNA, 62 nt, Human
agagaagggaaaugacaaaggggcagcuggccagauaagcuaggaugagagcagagacucag

SEQ ID NO: 3752 - RNA, 61 nt, Human
agagaagggagacauuguuuggauuuccuuuauacugugaaguuacaugcauaaaaggguc

SEQ ID NO: 3753 - RNA, 62 nt, Human
agagaauccaaguguuagaaggagaacaaaaauucaguauuauacagaucuaaaacucgcaa

SEQ ID NO: 3754 - RNA, 62 nt, Human
agagaaugaaauugcugaaagaucuuucaggacucuaccucauaucaguuugcuagcagaaa

SEQ ID NO: 3755 - RNA, 61 nt, Human
agagaaugagagcgacacagacguuaggcauuuccugcugaacguuuccccgaagagucag

SEQ ID NO: 3756 - RNA, 62 nt, Human
agagaauucagucuacagccauuuaaaugaucauugcugcuacagaagugcuuuaagagaau

SEQ ID NO: 3757 - RNA, 62 nt, Human
agagaauuuaucacaccacguccuuauuggaauaauaagcuacuugccuugaguuuauaauu

SEQ ID NO: 3758 - RNA, 62 nt, Human
agagaccauaaaggcuucaaaacuagaagugcgcaugaaggaugcuucaugcccuguucccc

SEQ ID NO: 3759 - RNA, 63 nt, Human
agagaccaucccaggaagaguggugggugguuuauacacuggaaauguugcguuuaugcuuuu

SEQ ID NO: 3760 - RNA, 62 nt, Human
agagacuaaugcugugcuucaaaaggugucucauaugaaggaugaaaaagaggcccugauaa

SEQ ID NO: 3761 - RNA, 62 nt, Human
agagacugcuucucccaaacauaacgcguuagccaugaaggagucggagcccuggguccgaa

SEQ ID NO: 3762 - RNA, 61 nt, Human
agagacugggggaggccggaucucuagagccauccugcugagugcccuguguguaaguccu

SEQ ID NO: 3763 - RNA, 62 nt, Human
agagaggcagcuuaucaaacucagcccaaaacucuguuuacauggguggggagauggagcag

SEQ ID NO: 3764 - RNA, 61 nt, Human
agagagggaaggcugccaggcacugcuuguaucccugcugauaagaggagggagucacucc

SEQ ID NO: 3765 - RNA, 61 nt, Human
agagagggugaacagggaacucuaugcuagauuugagauuaaaguggucauuugcagaucu

SEQ ID NO: 3766 - RNA, 61 nt, Human
agagauaaaauuaauaauaguucacuuguuauuugagauuaauuuggcauuugaaaugauc

SEQ ID NO: 3767 - RNA, 63 nt, Human
agagauggauauuucagcccucuccauccuagucaacacuggauccaccuagugccucugggc

SEQ ID NO: 3768 - RNA, 64 nt, Human
agagauucaguguauguauuuauuuacaugagaggaaacuggaauauaaucccauaaauuauca

SEQ ID NO: 3769 - RNA, 62 nt, Human
agagauuuuuguccuuaguuucuuugcuaucuaauguuuacacaaguaaauagucuaagauu

SEQ ID NO: 3770 - RNA, 62 nt, Human
agagcaacaguauuccucaauccugucuguucugcaguauuaagcuaagaacagguaaaaca

SEQ ID NO: 3771 - RNA, 62 nt, Human
agagcaguugccuaccacauaguacuuauucagucaguguuagaggauauuguaguauuauc

SEQ ID NO: 3772 - RNA, 62 nt, Human
agagccaacuugcagcaccugguuaugccuccuuucaucucaaagccaaagagcugccaggu

SEQ ID NO: 3773 - RNA, 61 nt, Human
agagccugggccccucuggccccaucucacaugacugugaaggggguguggcauggcaggg

SEQ ID NO: 3774 - RNA, 61 nt, Human
agagcguguccguugugaucccaguccuuugaaacugugaagccucgccccgcggccugcc

SEQ ID NO: 3775 - RNA, 49 nt, Human
agagcuugauuuucucuaaggaacuggaaugaggagccuuccccuugag

SEQ ID NO: 3776 - RNA, 63 nt, Human
agaggaaacuguucaaguauuggauuugaaaguaagugacuuauguuuaacagaacuaaugau

SEQ ID NO: 3777 - RNA, 62 nt, Human
agaggaacugaaucagcaugaaaaugcaguuucuucaucucaccauccuguauucuucaacc

SEQ ID NO: 3778 - RNA, 61 nt, Human
agaggaauauauuuuaauuaaaugccagacacuccugcugacaaugaaagaaauacuuugg

SEQ ID NO: 3779 - RNA, 62 nt, Human
agaggaucuaugugcugaccucagaagauguauauguuuacauaauuuaauacagauugaug

SEQ ID NO: 3780 - RNA, 61 nt, Human
agaggccgccuuuugaaauguuugccugucugaacugugaagacacuugggagugauugug

SEQ ID NO: 3781 - RNA, 64 nt, Human
agaggcucaucccucaguggcaacagaaacaggcacaacuggaagacuuggaaccucaaagcuu

SEQ ID NO: 3782 - RNA, 62 nt, Human
agaggcuggagaagaccuucagacaguccuuuuacuaccucacaaagugccaugcccgggac

SEQ ID NO: 3783 - RNA, 62 nt, Human
agaggcuuggacugguauauccaacgagaaacaaauaagcuaaagaaaguuuaaacucaaga

SEQ ID NO: 3784 - RNA, 61 nt, Human
agagggacagcacuaggcccaggaguaugaggcccugcugaacaucaaggucaagcuggag

SEQ ID NO: 3785 - RNA, 63 nt, Human
agagggagguggaggagcugggcugcuuuucccagcaguauuagugucccccaggacagggga

SEQ ID NO: 3786 - RNA, 62 nt, Human
agagguuuugauaggaaguauguuuguuucuuaguguuuacaaauauuaaguacucuugaua

SEQ ID NO: 3787 - RNA, 61 nt, Human
agaguaagagguucuuacuuguacauaggcuuuccugcugaaaacaggccccugcuguaca

SEQ ID NO: 3788 - RNA, 63 nt, Human
agaguaggguuaagguucucagugacacaagaauucaguauuaaguacauagguauuuacuau

SEQ ID NO: 3789 - RNA, 61 nt, Human
agaguauggguucuccauauagcaauacuucagugagauuaaguauaaacaguuuuuggca

SEQ ID NO: 3790 - RNA, 62 nt, Human
agaguauuaauacauggccaaaauaauuuaguuacuaccucauacaaacaauauaaugguua

SEQ ID NO: 3791 - RNA, 63 nt, Human
agagucucucagccuuugcuuacugguguuuccgacaguauuaacccagugcguggcaugucu

SEQ ID NO: 3792 - RNA, 61 nt, Human
agagugugugucauuuuuaauuagauucuuuccccugcugaguuggaaauuccagugcagc

SEQ ID NO: 3793 - RNA, 62 nt, Human
agaguuuaauuuuugaaaacuggcuacugcucuguguuuacagacgugugcaguuguaggca

SEQ ID NO: 3794 - RNA, 62 nt, Human
agaguuugcagcugguaaaaccagaggcuacauccaguauuacugcuaagagacauucuuca

SEQ ID NO: 3795 - RNA, 62 nt, Human
agauaacuaaucaaggccauuuaauccgucacauucaucucauaauagaaacacguucauau

SEQ ID NO: 3796 - RNA, 61 nt, Human
agauaauaaaagcuuuuuggggcaaccuccagaacugugaaaaauaaauuuguuauuucua

SEQ ID NO: 3797 - RNA, 62 nt, Human
agauaaugaucucauuguuuauuaaccuguauucuguuuacaugucuuuaaaacagugguuc

SEQ ID NO: 3798 - RNA, 62 nt, Human
agauaauugucuaguuagggggcagcuggagaaaauaagcuaaguuugcaauaacagaguac

SEQ ID NO: 3799 - RNA, 62 nt, Human
agauacaaaaaaucuuguauuuuuuuuuuguguguguuuacaaguaguaaauuuauuuucag

SEQ ID NO: 3800 - RNA, 63 nt, Human
agauacaguaaauuuuuagaaaaaaauaccauuuacaguauuauugugaaccauuuaacccuu

SEQ ID NO: 3801 - RNA, 62 nt, Human
agauacauugagauagaauuaaggaaaaacuuuaaugaaggaauguacccauguacauaugu

SEQ ID NO: 3802 - RNA, 62 nt, Human
agauacugaugacagugugggugacagcaugguaaugaaggacagugaggcuccugcuuauu

SEQ ID NO: 3803 - RNA, 63 nt, Human
agauauaauaaaagguguuuaucauaaaaaagaaacaguauuagauuuuggucuccauaaucu

SEQ ID NO: 3804 - RNA, 61 nt, Human
agauauauuuuuuaagugugaauguaacaacauacugugaauuccaucuugguuacaaaug

SEQ ID NO: 3805 - RNA, 64 nt, Human
agauauggagcaggccguuagaaaggagggagcagcaacuggaagguagaauagucuuauucaa

SEQ ID NO: 3806 - RNA, 62 nt, Human
agauauuuacaacugggagaaaugucuauuuagguguuuacauuaagcgguaugaaaguugu

SEQ ID NO: 3807 - RNA, 62 nt, Human
agaucaacaaugaaguauuuuauaaauguauuuaugcugcuagacugugggucaaauguuuc

SEQ ID NO: 3808 - RNA, 62 nt, Human
agaucauuuaaaaaagcaaaaucaagugcaauuuuguuuacaaaugguguauauuaaagauu

SEQ ID NO: 3809 - RNA, 63 nt, Human
agauccaauccucucaccaaaauuucaaaccuaggacacuggaaugacugcagggaucagugg

SEQ ID NO: 3810 - RNA, 63 nt, Human
agaucccauuuagccccugaacauaauaccaucugcaguauuauaaaagucauuuagaagguc

SEQ ID NO: 3811 - RNA, 64 nt, Human
agaucugagucuagaacccaggcuucuaaauuucuaggccaguacuacugcucucaaaagagau

SEQ ID NO: 3812 - RNA, 61 nt, Human
agaucuggaagaugguuuuuuaaaaaauccuggccugcugaacgaauaguuucuucugcaa

SEQ ID NO: 3813 - RNA, 62 nt, Human
agaugacugaguccucguagccaucucucuacuccuaccucagccuagacccuccuccuccc

SEQ ID NO: 3814 - RNA, 61 nt, Human
agaugagccuccugaagcccccuucccugccugccugcugacccguggccccagcucacuc

SEQ ID NO: 3815 - RNA, 63 nt, Human
agaugaggagguacagacacgugaccuuuuggugcacacuggagcuacuuggacaagaccagc

SEQ ID NO: 3816 - RNA, 62 nt, Human
agaugucccccaggcaucuugaucccagccugacugcugcuacaucuaauccccuaccaaug

SEQ ID NO: 3817 - RNA, 63 nt, Human
agauguggagguaauauuauuuuuucuucaauauaacacuggaggaaaccccuuaugaggaug

SEQ ID NO: 3818 - RNA, 61 nt, Human
agauguucucuuggcaugcuaaaucauggauaaacugugaaccaaaauauggugcaacaua

SEQ ID NO: 3819 - RNA, 62 nt, Human
agauugaaagauuucuguugaaacuuacacuguuucaucucagcuuuugaugguacugauga

SEQ ID NO: 3820 - RNA, 63 nt, Human
agauugauauuuuguguauugaacaggaagacugccaguauuaaaaaaauccuucugggaauc

SEQ ID NO: 3821 - RNA, 62 nt, Human
agauuuuuuuaacgagaaaaacacacagaagaagcuaccucagguguuuuuaccucagcacc

SEQ ID NO: 3822 - RNA, 61 nt, Human
agcaaaaccacucucuugaaucacguuaacuuuugagauuaaaaaaaaaaacgccauagca

SEQ ID NO: 3823 - RNA, 62 nt, Human
agcaaaagccauuucuguaccauaaaaauuuguugugcaauauuagaauuaucauauguuuc

SEQ ID NO: 3824 - RNA, 62 nt, Human
agcaaacugagcaccuuaggacuacagacguuuaucaucucacaguuucugugagucagggg

SEQ ID NO: 3825 - RNA, 62 nt, Human
agcaacagcagcucccauuucuagaacacauuuacaguauuacuauuuucuaggauauaaag

SEQ ID NO: 3826 - RNA, 62 nt, Human
agcaagcuccuauguguauauuuuccugaauuucucaucucaaacccuuugcuucuuuauug

SEQ ID NO: 3827 - RNA, 63 nt, Human
agcaaggaagcaaaaauaaaaaugaucaaaaaagaaacgguuaauucauuugaagaaacauag

SEQ ID NO: 3828 - RNA, 63 nt, Human
agcaauaccacgcagucccuccacuuucucaaagcacacuggaaaggccauuagaauugcccc

SEQ ID NO: 3829 - RNA, 62 nt, Human
agcaaucacaaacuaaagacugcggcuuguugaggugcaauacccugacucccaaaguuagu

SEQ ID NO: 3830 - RNA, 62 nt, Human
agcacacaguaauguuaucuggaagcucuguuuuuguuuacauuucuguaucccuggguuga

SEQ ID NO: 3831 - RNA, 62 nt, Human
agcacaguguauucagacagauacagugaaccaagugcaauauguaaggaugaaagaagaag

SEQ ID NO: 3832 - RNA, 63 nt, Human
agcacccagaacugcuggucagaggccugcaguguacacuggagagucagccuguggacccug

SEQ ID NO: 3833 - RNA, 64 nt, Human
agcacuacacaacuuaguuguuuuuuucuggaagaaaacuggaauuaaaaucauugauccuuua

SEQ ID NO: 3834 - RNA, 62 nt, Human
agcacugagacccccaugguaauguaacuuaauuauaagcuaugucacuacccuccuguaaa

SEQ ID NO: 3835 - RNA, 62 nt, Human
agcacugugcauguaaacagguuccuuugcucagaugaaggaaguaggggguggggcuuucc

SEQ ID NO: 3836 - RNA, 63 nt, Human
agcacuucugagccagaucugauccuaaucucugugugacuuagucucaagcauccaggaauu

SEQ ID NO: 3837 - RNA, 61 nt, Human
agcacuuugggaggcugaggcagguggaucauuugagauuaggaguuugagaccagccugg

SEQ ID NO: 3838 - RNA, 62 nt, Human
agcagaaucuccgugggacaucuuucuggagcaucaguauuacugcaggauuuggaagaaac

SEQ ID NO: 3839 - RNA, 61 nt, Human
agcagaggcauugccaggacuugggaaacagucacugugaaaugcgcugcguaucucauuc

SEQ ID NO: 3840 - RNA, 61 nt, Human
agcagaggcuccccucaugaaggaagccauugcacugugaacacuguaccugccugcugaa

SEQ ID NO: 3841 - RNA, 61 nt, Human
agcagcccgcaucaagcaagcccuccugggccaccugcugaucugacaguccaucguagua

SEQ ID NO: 3842 - RNA, 62 nt, Human
agcagccugaaccuugcuuugugucucguaaaggucaucucacggaauccaauugcugcuac

SEQ ID NO: 3843 - RNA, 62 nt, Human
agcagcuggucugacacuacgcgcagugcucgguuguuuacaaucaguggggaaaagggcag

SEQ ID NO: 3844 - RNA, 64 nt, Human
agcagcugucuugguaaaggagagagagagacauggggccaguaauuccggggugcucagaagu

SEQ ID NO: 3845 - RNA, 61 nt, Human
agcagcuucuaauuuucaaucaucuguugauauacugugaaacuuauuuuauuaaauuaau

SEQ ID NO: 3846 - RNA, 61 nt, Human
agcaggacaagcacuuucucagaagcccguggcccugcugacgagagacagcccaccccca

SEQ ID NO: 3847 - RNA, 63 nt, Human
agcaggggcaggucuccaaggcaagcccagcuggugugacuuagacaaugacgaggcuucaac

SEQ ID NO: 3848 - RNA, 64 nt, Human
agcaguuagcagaccuaaagcaagccugaauuggcuaugcaguacauuguauucuguuuggggg

SEQ ID NO: 3849 - RNA, 62 nt, Human
agcaguuccagaaggaccauucucaccuguguuuuguuuacauggaccacuacagaaauuag

SEQ ID NO: 3850 - RNA, 63 nt, Human
agcauaagugguuuucuucaggaaaauaaauaucacaguauuaucuguguuaaaaugguuuuu

SEQ ID NO: 3851 - RNA, 61 nt, Human
agcauaccguuugucugucacauuaguagauucugagauuaaaaaaaauuuuuaaagagug

SEQ ID NO: 3852 - RNA, 52 nt, Human
agcauggugccucauguaaaacccacacuggagcgauauuguuggcaaaacu

SEQ ID NO: 3853 - RNA, 64 nt, Human
agcauuaaaauggagaaaagaaaguuuucugaaaaaaugcaguaaauauaagccacauuucuaa

SEQ ID NO: 3854 - RNA, 61 nt, Human
agcauucaacagagaacucugucuuaagcuucaacugugaaaaugaugacgggcuuguagc

SEQ ID NO: 3855 - RNA, 64 nt, Human
agcauucuucuagucagaggguggaauggcagcagcaacuggaagaaaaugaguuuuuuggugc

SEQ ID NO: 3856 - RNA, 62 nt, Human
agcauuggucacaauguaccaacugcuuucugcauuccguuaaauaucaucuaacagucuaa

SEQ ID NO: 3857 - RNA, 61 nt, Human
agcauugugucccuucgagauggggauccacacacugugaaugugaugacuguacuucagg

SEQ ID NO: 3858 - RNA, 64 nt, Human
agcauuguuugugauauuucguguacugcaaaguguaugcaguauucuugcacugagguuuuuu

SEQ ID NO: 3859 - RNA, 61 nt, Human
agcauuuagucagucccccaaacagucaugccaacugugaaggaaugucccacaaaacauu

SEQ ID NO: 3860 - RNA, 62 nt, Human
agcauuuccuuuuauuaauauaaauuaaaacaaauguuuacauccgcauuuccuuuuauuaa

SEQ ID NO: 3861 - RNA, 62 nt, Human
agccaacccaccccccaguccacauggucaccacugcugcuaccagcugcucagugcagugg

SEQ ID NO: 3862 - RNA, 62 nt, Human
agccaacuagccccugggguggccaccaguaugacaguauuauacgcuggcaacacagaggc

SEQ ID NO: 3863 - RNA, 64 nt, Human
agccaauuguuuguacuauuuauguaccuuuuucauaacuggaauugccaaauaagcauggaga

SEQ ID NO: 3864 - RNA, 62 nt, Human
agccacuagaaagagaaauaaacccaauggcauguguuuacaggaagaaagauuaccuucag

SEQ ID NO: 3865 - RNA, 62 nt, Human
agccacugcacccggcuugaaucauccuuuuguccaguauuauauccaugcuguauaugcua

SEQ ID NO: 3866 - RNA, 64 nt, Human
agccacugcaccuggccucaugucucuggauuuauaaugcaguaugaauauacuuugugcuuua

SEQ ID NO: 3867 - RNA, 62 nt, Human
agccagaacuugaagucuuuugucccaguuugggaugaaggaaaggaggaagaggcgguggc

SEQ ID NO: 3868 - RNA, 61 nt, Human
agccagaaggaaaagaguaaugguauuuucuagacugugaagauucaguucaaauguuauc

SEQ ID NO: 3869 - RNA, 64 nt, Human
agccagagagcccuuucagaaucugacccaaaagauggccaguauucuaagaaaaagcacauau

SEQ ID NO: 3870 - RNA, 62 nt, Human
agccagcauggauaauaacccagauaacuaaccccuaccucacaggauaaaaaggauuacau

SEQ ID NO: 3871 - RNA, 61 nt, Human
agccagcucauuucacuuuacacccucauggacugagauuauacucaccuuuuaugaaagc

SEQ ID NO: 3872 - RNA, 62 nt, Human
agccaggaaacaauaggaaccaaaagccucugccugcugcuauugcaauucccaggaucucu

SEQ ID NO: 3873 - RNA, 63 nt, Human
agccaucaugauuuuggccacagaugaaaauaugaacacuggaaaugagcgccauuuaaauga

SEQ ID NO: 3874 - RNA, 64 nt, Human
agccauugauugauuucccacaauugcagucugagcaacuggaauguaacucucuccauuggau

SEQ ID NO: 3875 - RNA, 61 nt, Human
agcccaaguacuuuuaaguggaggaaaugaaguacugugaauuuuuaaaacagaugagaua

SEQ ID NO: 3876 - RNA, 62 nt, Human
agcccaugaaagagaucauugccugacccagggacuaccucaagggcuuuugaugaggacaa

SEQ ID NO: 3877 - RNA, 62 nt, Human
agccccaucugcgggggcagugcucacccacaccauaagcuacugccauccuggcccagggc

SEQ ID NO: 3878 - RNA, 63 nt, Human
agccccggccuuucgcggugacacaaugguuagggaacgguuagaacgcgcucuacauccgcu

SEQ ID NO: 3879 - RNA, 61 nt, Human
agccccucuccucuucaggcuacaggguugucaccugcugaguccucagguuguuuggccu

SEQ ID NO: 3880 - RNA, 61 nt, Human
agcccuagacccauggguggcuaaauccacuggacugugaagacuauaauuuauuuccaua

SEQ ID NO: 3881 - RNA, 61 nt, Human
agcccucuccuggggggccugcugggcaggcgaccugcugacccacggucacugcuguguu

SEQ ID NO: 3882 - RNA, 62 nt, Human
agccgagguggggggauauggggauucaggcaauuguuuacacacuuugaauaacugcaaag

SEQ ID NO: 3883 - RNA, 62 nt, Human
agccgccaccccacguuucuguaccgggucucugcaguguuaaacggacguguaaauagugg

SEQ ID NO: 3884 - RNA, 62 nt, Human
agccuauugucacauggguuuuuaauccuggccuugcugcuagaaaucugugcuugaagucc

SEQ ID NO: 3885 - RNA, 63 nt, Human
agccuccgggggaaaaaagcuuagccuagcagucagugacuuacuugcacuuuuugcacauag

SEQ ID NO: 3886 - RNA, 62 nt, Human
agccucucuaguuuuaguuuacugauagguuuuaugcugcuaagaauccaaccaacagccuc

SEQ ID NO: 3887 - RNA, 63 nt, Human
agccugaaagauacaggggaucauguuaaaaauagcaguauuauuuuucgucucaaugguauu

SEQ ID NO: 3888 - RNA, 62 nt, Human
agccugccaagaauuuuauuucugcuguuuuuuuugcugcuaaagaaaggaacuaagucagg

SEQ ID NO: 3889 - RNA, 62 nt, Human
agccuggaaaaaaaaauuaggaccacaugugagauguuuacaagacacccagaacaguggua

SEQ ID NO: 3890 - RNA, 62 nt, Human
agccuuuuaauuuauugaaauguuucaugacuacugcugcuagcucuucaagccagguucau

SEQ ID NO: 3891 - RNA, 61 nt, Human
agcgccacugcaucucagaggaaugccaacccuacugugaacugugcaugcgagggaucug

SEQ ID NO: 3892 - RNA, 61 nt, Human
agcguuccuggccagagcucuaccucuuugccuccugcugaccccugacagcgucccgugg

SEQ ID NO: 3893 - RNA, 62 nt, Human
agcguugguaguagcccaccugcaugaggacggccaguguuaacaauauuuuuguucugauc

SEQ ID NO: 3894 - RNA, 62 nt, Human
agcuaacuuuuaaguggauuuugcaaaugaaaaccaguauuacugaguuuuacauacucgaa

SEQ ID NO: 3895 - RNA, 63 nt, Human
agcuaccuagaauuuacagucucuguuucauggcaacacuggauaauggcuuugugaaauuua

SEQ ID NO: 3896 - RNA, 62 nt, Human
agcuacuauaggaugauguuaguauugguuuugagugcaauagguuuuuuccuaaacaaaca

SEQ ID NO: 3897 - RNA, 62 nt, Human
agcuacuuaucaaccagacugaccacaagaacugucaucucaucaaugaaggaguaacugau

SEQ ID NO: 3898 - RNA, 64 nt, Human
agcuacuugagaggcugaggcaagagaaucacuugaaacuggaaggcggggguugcagugagcc

SEQ ID NO: 3899 - RNA, 62 nt, Human
agcuaugcacccaguuggccuuagaaaaccacaauguuuacagcccugucuuagggccgcgg

SEQ ID NO: 3900 - RNA, 61 nt, Human
agcucacccagggcugcugcccaaccaugggccacugugaacagacuucaguccucuguuu

SEQ ID NO: 3901 - RNA, 62 nt, Human
agcuccagugccagcaauaggguggcacagaagcucaucucagucauccugcaggcacauga

SEQ ID NO: 3902 - RNA, 64 nt, Human
agcucccuuagugcuuuuugucccuucccgaacaauaugcaguagcuuuaagccauucaagcuc

SEQ ID NO: 3903 - RNA, 61 nt, Human
agcucuacaauuuguuuccuucaagcuuaacuuugagauuauaaaacuggguuuagccagu

SEQ ID NO: 3904 - RNA, 62 nt, Human
agcucuauuuccccaccccacuauccucacucccauaagcuaagccuuaugugagccccuuc

SEQ ID NO: 3905 - RNA, 62 nt, Human
agcucuucgcccugcguuccuuccccggggucuucuaccucagacacucugacuaccuccca

SEQ ID NO: 3906 - RNA, 62 nt, Human
agcugaaacuagucuuuucugaagaaccguguaucaguguuagaugugcaucccguuuuguc

SEQ ID NO: 3907 - RNA, 62 nt, Human
agcugaaggucugcgucacggugaaaauucgggauguuuacagagcaucacaaaugccucuc

SEQ ID NO: 3908 - RNA, 63 nt, Human
agcugagcaucaggaccuugccucgaauugucuuccaguauuacggugccucuucucugcccc

SEQ ID NO: 3909 - RNA, 61 nt, Human
agcugaugcgccugccuuggccucccaaacugcugagauuacagaugugagccaccgcacc

SEQ ID NO: 3910 - RNA, 51 nt, Human
agcugauguucaggcauaaggguuguuuacaggugaauucaugacaccuuu

SEQ ID NO: 3911 - RNA, 64 nt, Human
agcugcuugaaaacauuguauuuuuuuuuuuuaacgaugcaguauuugugcguuccagaaaagg

SEQ ID NO: 3912 - RNA, 62 nt, Human
agcugcuugcagcaacuugauuuccccaaguccugugcaauagccccaggauuggauuccuu

SEQ ID NO: 3913 - RNA, 62 nt, Human
agcuggcuggcucagcuaaguggcacgaugacgcaugaaggagauuauguugugcucuuuau

SEQ ID NO: 3914 - RNA, 62 nt, Human
agcugggggcaucggcaaggccaagcugcgcagcaugaaggagcgaaagcuggagaagaagc

SEQ ID NO: 3915 - RNA, 62 nt, Human
agcuggucucuggggggagcugagaacucgcuugcuaccucacauccuuuuccccagacuuu

SEQ ID NO: 3916 - RNA, 62 nt, Human
agcuguaagagucuggcuuagaacagaccucucugugcaauaacuuguggccacuggaaauc

SEQ ID NO: 3917 - RNA, 62 nt, Human
agcugucugcucgcauuugcuccuguugccgcccucaucucagagaagugcucaggcagugc

SEQ ID NO: 3918 - RNA, 63 nt, Human
agcugugccuuucauuacuuuguuacagaaaugcagugacuuauacuaagacaauuuauuguu

SEQ ID NO: 3919 - RNA, 62 nt, Human
agcuguuuuacuucauugaauacgaucauguacccaguguuaacucuuuguuguugucccuu

SEQ ID NO: 3920 - RNA, 62 nt, Human
agcuuaaacuauugacucuauaccucuaaagaauugcugcuacuuugugcaagaacuuugaa

SEQ ID NO: 3921 - RNA, 62 nt, Human
agcuucagaggaagcucguuuaauuuuauugugcucaucucaggaacaaaagcauuuuuuag

SEQ ID NO: 3922 - RNA, 62 nt, Human
agcuucccgcugggaauaaugaugccugcccuaucuaccucacagacuuguuaugaggauaa

SEQ ID NO: 3923 - RNA, 63 nt, Human
agcuucccugcaucuugguccuuguccccuuggccacacuggagaggugauggggcagggcug

SEQ ID NO: 3924 - RNA, 61 nt, Human
agcuuccuguauuuuauuagugguccuugaaaaacugugaauguuugggaauugguagaaa

SEQ ID NO: 3925 - RNA, 62 nt, Human
agcuucguacaaaugugaaguauuaauauuaucgcaguauuauuguuguuauuauuauuguu

SEQ ID NO: 3926 - RNA, 62 nt, Human
agcuucuccaggaggccaagcagaggcuccccucaugaaggaagccauugcacugugaacac

SEQ ID NO: 3927 - RNA, 62 nt, Human
agcuucugaggguaacaacagagugucagauaugucaucucaaccucaaacuuuuacguaac

SEQ ID NO: 3928 - RNA, 62 nt, Human
agcuucugaggguaacaacagagugucagauaugucaucucaaccucagacuuuuacauaac

SEQ ID NO: 3929 - RNA, 62 nt, Human
agcuugcuuucaagcuucaccccuugcacuuaacauaagcuauuuuuggcauuguguuauca

SEQ ID NO: 3930 - RNA, 62 nt, Human
agcuugguuuccauaacauagagcauugguugacuguuuacagaagacucacucaccaggau

SEQ ID NO: 3931 - RNA, 61 nt, Human
agcuuguugguuauuaauagagcucuaauuuuaacugugaaaucauggaguuucuuuaaau

SEQ ID NO: 3932 - RNA, 62 nt, Human
agcuuuauauguaaagaauuuuagaagaucuuggugcugcuauuccugcuggaggaaugaau

SEQ ID NO: 3933 - RNA, 64 nt, Human
agcuuuauucuaagcaaaucugugucuacuuuaaaaaacuggaaauggaaaaaaaaauaaaucu

SEQ ID NO: 3934 - RNA, 62 nt, Human
agcuuuguauuauucuuccacauaugcuggcugcuguuuacacacccugccaaugccuuagc

SEQ ID NO: 3935 - RNA, 63 nt, Human
agcuuuguuuugugguaguccuuuugggaagaauccaguauuauccacaauuauuggcaaagu

SEQ ID NO: 3936 - RNA, 63 nt, Human
agcuuuuacuugggcgcccgccgucucuggcgcgaacacuggaaugcauauacuacuuuaugu

SEQ ID NO: 3937 - RNA, 62 nt, Human
agcuuuuguuauauugugccuauaaagcaaauuauguuuacauaaaaauauaaauaaaguau

SEQ ID NO: 3938 - RNA, 61 nt, Human
agcuuuuucagggaacuaguucuaaaacucuuaccugcugagaauaagucuuaacacuaag

SEQ ID NO: 3939 - RNA, 62 nt, Human
agcuuuuuuuuaaaaggaaaagauaccaaaugccugcugcuaccacccuuuucaauugcuau

SEQ ID NO: 3940 - RNA, 62 nt, Human
aggaaaaaucauucaaguggcaugccaagucccuaugaaggaagggcugcuaucaaaccuac

SEQ ID NO: 3941 - RNA, 62 nt, Human
aggaaagggaaaggguaggccuguagacuaacgcuguuuacacccuuguucugucaaagcaa

SEQ ID NO: 3942 - RNA, 62 nt, Human
aggaaaugggcauagaguagagaauagcuucauauguuuacacguuugcauagacuacacac

SEQ ID NO: 3943 - RNA, 62 nt, Human
aggaacccuuacaguaggagcccagcucugaaaccaguguuagggaagggccugccacagcc

SEQ ID NO: 3944 - RNA, 63 nt, Human
aggaacuaauuucuucuccuggaguugcauugauucaguauuacaaauauauagcacaucacc

SEQ ID NO: 3945 - RNA, 62 nt, Human
aggaagaggaagagcagaaugucuguauacuacaugcugcuaagguagugaauaaaucagua

SEQ ID NO: 3946 - RNA, 62 nt, Human
aggaagauacuuuuguuaaccauuucugaaauucaacuggaagcuucaugugucaggaacau

SEQ ID NO: 3947 - RNA, 62 nt, Human
aggaaggcuugguuuaauaaagacugauuuuguucaguguuauauguuagcugauacauauu

SEQ ID NO: 3948 - RNA, 62 nt, Human
aggaagucuccccacccccgcccuggccaagaacgugcaauaaauuggaaguuugccccggg

SEQ ID NO: 3949 - RNA, 62 nt, Human
aggaaucagggguuuggaaggaguagggaggagaaugaaggaaaaugcaaccagcaugauua

SEQ ID NO: 3950 - RNA, 61 nt, Human
aggacacaagugacacaaggccacugugaugucugagauuacauaacgaagacauccuuuu

SEQ ID NO: 3951 - RNA, 62 nt, Human
aggacacauuuaacaaguaacauuucuagggaaaaugaaggaaguaccacaaacuggcuaga

SEQ ID NO: 3952 - RNA, 62 nt, Human
aggacagaaaccacuuaguuuuuaauaaguggcucaguauuacaauugcagcgaugccuggc

SEQ ID NO: 3953 - RNA, 62 nt, Human
aggacaugaauggccuaaaacugauuuuuuuuuuuuccguuaaaaugugugugucaagauac

SEQ ID NO: 3954 - RNA, 61 nt, Human
aggaccgauuccaggcacuuucuguagcaaaugacugugaauuacgacuucucuugcccuu

SEQ ID NO: 3955 - RNA, 62 nt, Human
aggacggucuacucagcacaacugacugcuucagugcugcuaucagaagaugucuucuaucu

SEQ ID NO: 3956 - RNA, 61 nt, Human
aggacucaggcauugcugaaagaguuaaaaguaacugugaacaaauaauuuguucugugcc

SEQ ID NO: 3957 - RNA, 62 nt, Human
aggacugauacaaagaaagugcaugaggcaaugucaguauuaucugacaucuuucuuuucag

SEQ ID NO: 3958 - RNA, 64 nt, Human
aggacugcuaaaaagaauauuuuuuuguggugucagaacuggaaaaagcacuuucccuucgggc

SEQ ID NO: 3959 - RNA, 63 nt, Human
aggagaagggaaguggcagugagguguuuggcaggacacuggaauuccauaggaaucuccaua

SEQ ID NO: 3960 - RNA, 64 nt, Human
aggagaagucccggcuguuggagaaggagaaccgugaacuggaaaagaucauugcugagaaaga

SEQ ID NO: 3961 - RNA, 62 nt, Human
aggagaggauccuugcucccaacgucuacuucuccuaccucaacagggguccagggugcagu

SEQ ID NO: 3962 - RNA, 62 nt, Human
aggagaggccuggggauuggggaagcugucaucucaguguuaauaaucaacuugcuucuaac

SEQ ID NO: 3963 - RNA, 62 nt, Human
aggagauuaguguuuacuugcugugguuguggugugcugcuacuuaauuauagguagugaca

SEQ ID NO: 3964 - RNA, 62 nt, Human
aggagccugcacauuugggugagcagacccaagcuguuuacagcucuuucuuguccugccau

SEQ ID NO: 3965 - RNA, 62 nt, Human
aggaggaacaaguaaaaaccaaaugguuacauugugcugcuagaaauaaugucauucucaau

SEQ ID NO: 3966 - RNA, 61 nt, Human
aggagggcuccugaacuccagagggcaguucugccugcugaagucccucugcaaagccugu

SEQ ID NO: 3967 - RNA, 64 nt, Human
aggagucauaccuagaauaguuacacacaagagggaaacuggaagccaaacacuguacaguauu

SEQ ID NO: 3968 - RNA, 64 nt, Human
aggagugacagccgcagacacacgacagccggcagcaacuggaauggcagcaauuaaggguggg

SEQ ID NO: 3969 - RNA, 62 nt, Human
aggagugguuugaguaguacagaccucgaagccuugcugcuaacacugagguagcucucuuc

SEQ ID NO: 3970 - RNA, 61 nt, Human
aggaguuccccggaacccgugcagauuaaaguaacugugaaguuuucccuccgcgggcgcu

SEQ ID NO: 3971 - RNA, 64 nt, Human
aggaguucgagaccagccuggccaagagaccagccuggccaguauggugaaacccugucucuac

SEQ ID NO: 3972 - RNA, 61 nt, Human
aggaguuuauccuuuccguaaucucuuuuuaacccugcugacuauuacagggcuuguuuaa

SEQ ID NO: 3973 - RNA, 62 nt, Human
aggauacuucccccauggagauuccuguccuagucuaccucagucucagugacagccacaca

SEQ ID NO: 3974 - RNA, 62 nt, Human
aggauaugguggcuguguggacaagaaauugguuucaucucagaagggugcuucccuacaaa

SEQ ID NO: 3975 - RNA, 64 nt, Human
aggauauuuguuuauguuuguuuuuugggggaaagaaacuggaacucaguguuaccuuaaaguu

SEQ ID NO: 3976 - RNA, 62 nt, Human
aggaucaagaaugugaacuagaauuuuugucuacugcugcuagaguuuacaauugguacaac

SEQ ID NO: 3977 - RNA, 61 nt, Human
aggaucuggccuuguggucacuggcaucugagcccugcugauggcuggggcucucgggcau

SEQ ID NO: 3978 - RNA, 63 nt, Human
aggaugaggugguggaguggagugagagcaauuguaacgguuaacuguaacguuuucuuucac

SEQ ID NO: 3979 - RNA, 63 nt, Human
aggcaaccaccuucaccuucacacagauugaggagacacuggacuuuuuacccauuuucuuua

SEQ ID NO: 3980 - RNA, 64 nt, Human
aggcaacuccauuuuaagaagcugccuuuuucacaaaacuggaagaaauaaaagcgguuggaau

SEQ ID NO: 3981 - RNA, 61 nt, Human
aggcaagggcauccacuccaaugcccaccuaguacugugaagcuggauaacaaaagcuugu

SEQ ID NO: 3982 - RNA, 62 nt, Human
aggcacugagaaugauaguaauaggauacaauguauaagcuacucacuuaucugauacuuau

SEQ ID NO: 3983 - RNA, 62 nt, Human
aggcacugggacaucacaggcuucaguaccugaccaguauuaguugcauauaucauugaaca

SEQ ID NO: 3984 - RNA, 64 nt, Human
aggcagaagggcgacucucaccucucaugugcuucuggccaguaggucuuuguucugguccaac

SEQ ID NO: 3985 - RNA, 62 nt, Human
aggcagaguaacauuacuuaaaaaaaaaaggauauguuuacauuuaauuuuggcuaccagga

SEQ ID NO: 3986 - RNA, 62 nt, Human
aggcagcagucacagugucuccugggcuguggucucaucucaacguucaaccggggaugggu

SEQ ID NO: 3987 - RNA, 61 nt, Human
aggcaucaaagcaccugucgccuccguggucccccugcugagggagugcggccucugcaag

SEQ ID NO: 3988 - RNA, 61 nt, Human
aggcaucugaggcagccagcccacucggaaaggccugcugacugcacuccagaugucaaga

SEQ ID NO: 3989 - RNA, 64 nt, Human
aggccaaauucccuccucccuucuacugcuucuaccaacuggaagcacagaaaacuagaauuuc

SEQ ID NO: 3990 - RNA, 62 nt, Human
aggccagggucagacccagccaggacuccucauuucaucucacagacacaauaaaaaagcau

SEQ ID NO: 3991 - RNA, 61 nt, Human
aggcccccagaaauccaguguaaaugcucagccugagauuaaggggacagaagaauggacu

SEQ ID NO: 3992 - RNA, 63 nt, Human
aggcccugggucacuuuggaggccccucuugguccacacuggacuggccgggaggugaugggc

SEQ ID NO: 3993 - RNA, 62 nt, Human
aggccgccagcccggaggcugcagcccagaaacucuaccucauccacacuggugcagggagc

SEQ ID NO: 3994 - RNA, 62 nt, Human
aggccucaucuuucugugccgcgggacucugcaccuaccucacaggguuguugugaggcuca

SEQ ID NO: 3995 - RNA, 62 nt, Human
aggccugugcugcccgccucaggagguggccgacugcugcuagcggccugccgccacgucag

SEQ ID NO: 3996 - RNA, 62 nt, Human
aggccuugccuugaaggggcagcuguggccuaggcuaccucaagacucaccucauccuuacc

SEQ ID NO: 3997 - RNA, 64 nt, Human
aggccuuucacguauuccgucugcacaggcaaccaaggccaguagaaagcuauggcugcaaaac

SEQ ID NO: 3998 - RNA, 62 nt, Human
aggcgcucaugauuguuucugauuguuucacgcaugcugcuaacccagagccugggcccaaa

SEQ ID NO: 3999 - RNA, 62 nt, Human
aggcuauaaccuaaccucgacuauuuguuguuaugugcaauacuguuuguacuguuuguaua

SEQ ID NO: 4000 - RNA, 62 nt, Human
aggcucauuguaguuaaccuauauuaaguaauguauaagcuagguguucagacuauuuucua

SEQ ID NO: 4001 - RNA, 63 nt, Human
aggcugaaaacccaugcugcuguuauacacaauggcaguauuaacaagcauuuuaaaccuuug

SEQ ID NO: 4002 - RNA, 63 nt, Human
aggcugagagaguuaagugaaugucuaaggucacacaguauuaagugacagugcuagaaauca

SEQ ID NO: 4003 - RNA, 64 nt, Human
aggcugucauuccugucgaugaccugaaaggacacaaacuggaauuuucaggucuguccccugc

SEQ ID NO: 4004 - RNA, 62 nt, Human
aggcugugauuucaucaaaaguccuuuuagcauucuaccucaaagggacacuuaguaugccu

SEQ ID NO: 4005 - RNA, 61 nt, Human
aggcuuaaauaguuuaaguaggugaugggaagaugagauuaccucauuuagggcucaggca

SEQ ID NO: 4006 - RNA, 62 nt, Human
aggcuuguggaggaaaggaaccaagugacucugauguuuacaaagcaccuaugaaacccugu

SEQ ID NO: 4007 - RNA, 64 nt, Human
aggcuuuauucuuccaaguucauucauacucaaagaggccaguacuuugccauccuugcacuuc

SEQ ID NO: 4008 - RNA, 63 nt, Human
aggcuuugaucuuggggacuuuucccauauauuucacacuggagugaaugaaguuguacuuca

SEQ ID NO: 4009 - RNA, 63 nt, Human
agggaagaaagggggccugcaaaggaagcaguagagugacuuaaacaucuugcgaggcagccu

SEQ ID NO: 4010 - RNA, 62 nt, Human
agggaagacuuuugaaagccccuuugcugacuaucuaccucaguuugccucccggcaaacuc

SEQ ID NO: 4011 - RNA, 62 nt, Human
agggaagcucuuggagcugugaguucucccuguacaguguuaccauccccgaccaucugauu

SEQ ID NO: 4012 - RNA, 62 nt, Human
agggagaccuauagguuaauuguuuaguuauaggcaguguuaaauuaggcagauuuugacau

SEQ ID NO: 4013 - RNA, 62 nt, Human
agggagagagcgaacacccacgcugguuucugugcaguguuaggaaaaccaaucagguuauu

SEQ ID NO: 4014 - RNA, 61 nt, Human
agggagccccucucaccaccugcccucuacuuuccugcugaaaugacauugguuuuuacac

SEQ ID NO: 4015 - RNA, 62 nt, Human
agggagcuugcugccuccugccuugcuacacuaauguuuacagcaccuaagcuuagccucca

SEQ ID NO: 4016 - RNA, 62 nt, Human
agggaggaugaguaaggucauuaguaauaaaaccucaucucaauagccacaaaaagacaaau

SEQ ID NO: 4017 - RNA, 62 nt, Human
agggaugugacauuaccuccuguagauaugcuaacaguguuauucuuucauuuccaaggguu

SEQ ID NO: 4018 - RNA, 62 nt, Human
agggcaguauuaacccaccaugcuggaaggggaaaugaaggacaaaaaugcacagggagucu

SEQ ID NO: 4019 - RNA, 61 nt, Human
agggcagugcagcacuaggcaggugugaggagcccugcugaggucacuguggggcacgguu

SEQ ID NO: 4020 - RNA, 64 nt, Human
agggcauuaaauauauguuguguaugaaguaucucaaacuggaacauaaauuuagugaucaaac

SEQ ID NO: 4021 - RNA, 61 nt, Human
agggccacucaacagagaggaccaacauccaguccugcugacuauuugacccccacaacaa

SEQ ID NO: 4022 - RNA, 62 nt, Human
agggccucuuucccagcuuucuugcuugccuucugugcaauauuucuuggagaauuuggaug

SEQ ID NO: 4023 - RNA, 62 nt, Human
agggcggggggcagcggggggucucccuccggaccuaccucagggagcugagcgugcaggcg

SEQ ID NO: 4024 - RNA, 64 nt, Human
agggcuggguaggcaggugucuuggacccaccugaaaugcaguaucaucugauuuacucuuugg

SEQ ID NO: 4025 - RNA, 63 nt, Human
agggcugggucaggauucaccagcuuguguugcagacacuggagcgauugccuggcccucccu

SEQ ID NO: 4026 - RNA, 56 nt, Human
aggggaaccaacguuuugaaauaagucugugacuuaacgucgucaaguauggcaua

SEQ ID NO: 4027 - RNA, 62 nt, Human
aggggagggccaggauuccucucucaggucacuccaguguuacuuuuaauuccuagagggua

SEQ ID NO: 4028 - RNA, 62 nt, Human
aggggcaucucugugucugagugugccugguguguguuuacaaagggagaguuggcugcucc

SEQ ID NO: 4029 - RNA, 62 nt, Human
aggggcauggaggcaguggcgccuuauggauaggucaucucagcccaaagggccuccuuggc

SEQ ID NO: 4030 - RNA, 62 nt, Human
aggggccuagcucgcugccgacagaagucacugccuaccucaggguccccuuaccugggugg

SEQ ID NO: 4031 - RNA, 61 nt, Human
aggggcuggagcuuucccucugauccguuuuacacugugaaaaccgcaggccugucgccua

SEQ ID NO: 4032 - RNA, 62 nt, Human
aggggcuggcucuggauaaacugguagccacuaucaguguuaaguuucacauuuaaccugca

SEQ ID NO: 4033 - RNA, 63 nt, Human
agggggcuccguccugcaggcuggagguggcauccacacuggacagcagggaggaggggagug

SEQ ID NO: 4034 - RNA, 62 nt, Human
agggguacccaugcccccugcccucgccuggaaucaguguuacugcaucugauuaaaugucu

SEQ ID NO: 4035 - RNA, 62 nt, Human
aggggugagaagggaugaggaaaaggauuaaucaaugaaggagaacucgugacucauuuaau

SEQ ID NO: 4036 - RNA, 62 nt, Human
aggguaaaacuaguuauggcaguaguaugcacagcaguguuagccauuucauauguauguaa

SEQ ID NO: 4037 - RNA, 62 nt, Human
aggguaaacaggccagguguccuuugaagaacuuuguuuacaucaaauugaugaaauuacag

SEQ ID NO: 4038 - RNA, 62 nt, Human
aggguacucacauuuuuugaaauagcucguguguaugaaggaauguuauuauuuuuaauuua

SEQ ID NO: 4039 - RNA, 61 nt, Human
aggguagcaccgugagaaaugggcuguauugauacugugaauguuuguuuuccaagcuguu

SEQ ID NO: 4040 - RNA, 62 nt, Human
aggguaguugccaauaaccugaagaagcuggcauuguuuacagaaacagaucaagggcuaua

SEQ ID NO: 4041 - RNA, 62 nt, Human
agggugcgcagggaggccgggcuugggggcagccugcugcuauguccuugcuggcgcccaua

SEQ ID NO: 4042 - RNA, 63 nt, Human
aggguggagaucuggguuucuagaccucacugaacacacuggaauggcugaguuuaacuuauu

SEQ ID NO: 4043 - RNA, 61 nt, Human
aggguggggagagcuggcaggcccagggcuuguccugcugaccccagcagacccuccuguu

SEQ ID NO: 4044 - RNA, 63 nt, Human
agggugugauuucuauaccaaagauaugcuuauuucaguauuagaaaaauauucuucuuacau

SEQ ID NO: 4045 - RNA, 63 nt, Human
aggguuaaaaauuaucaguuuaaucucuuuaagaacaguauuaucagaguuuaaaaugaguua

SEQ ID NO: 4046 - RNA, 63 nt, Human
aggguuccugcaccuggaauccaguguguccaagccaguauuaaauuaucucaacacugaccc

SEQ ID NO: 4047 - RNA, 62 nt, Human
aggguucuuccccuggugauucucgccugcuuucucaucucaggggaggcaguggcaccucc

SEQ ID NO: 4048 - RNA, 64 nt, Human
aggguugguugccccucaccucagagcucccccaaaggccaguaauggauccccggccucaguc

SEQ ID NO: 4049 - RNA, 64 nt, Human
aggguugucacauuauaaaaucuuuaggaaaaugugaacuggaaaacgcuucggucaguuuuag

SEQ ID NO: 4050 - RNA, 62 nt, Human
aggguuguuuucuguuaagcaaagccgagauccagugcaauaccuggacugucaccguccug

SEQ ID NO: 4051 - RNA, 61 nt, Human
agguaauccgcccaucucggcuucccaaagugcugagauuacaggcaugggccaccacgcc

SEQ ID NO: 4052 - RNA, 61 nt, Human
agguaauuaaaaaccuaagaaauggcuguaaacugagauuacaaaaaaccagaggccuuuu

SEQ ID NO: 4053 - RNA, 62 nt, Human
agguacaaaaauggcuuuuauacuuaaauauuuuuguuuacauuuccagaauagugggggga

SEQ ID NO: 4054 - RNA, 62 nt, Human
agguacaagcuuugugcuaagaaguugacauacuauaagcuacaaaaguucuguaaaguaga

SEQ ID NO: 4055 - RNA, 63 nt, Human
agguaccagcuuccuuuccagcuggagaggccccaacacuggaugguucuguagggagccuag

SEQ ID NO: 4056 - RNA, 62 nt, Human
agguacuuugggccaguagaguauacuacaguuauguuuacaucugaaaguguaguagggau

SEQ ID NO: 4057 - RNA, 62 nt, Human
agguagaaauguacccccuccccaagcaugaaaaucaucucacugaaagauacgccuggcug

SEQ ID NO: 4058 - RNA, 64 nt, Human
agguagcacacaggaccaagagcagcacaugcaaucaacuggaauaauauaguaauccuguaac

SEQ ID NO: 4059 - RNA, 63 nt, Human
agguauuuucaaacuagcuucuucaaacuuaacaugugacuuauucuucuauaguuucuagaa

SEQ ID NO: 4060 - RNA, 63 nt, Human
agguauuuucacugaacaaggucaauugguuaccucaguauuacagccaauauaguccaaggg

SEQ ID NO: 4061 - RNA, 61 nt, Human
aggucauccaccugccucggccucccagagugcugagauuacaggcgugagccuccgcgcc

SEQ ID NO: 4062 - RNA, 62 nt, Human
agguccacugugacugaggcccucaccuccacgccuaccucauagcuucacagccuugccuu

SEQ ID NO: 4063 - RNA, 62 nt, Human
aggucuugaugugcauagcuucugauaacccugugugcaauaauaugauuugcagggcauuu

SEQ ID NO: 4064 - RNA, 61 nt, Human
aggugauccacccaccuuggccucccaaagugcugagauuauaggcaugagccaccacgcc

SEQ ID NO: 4065 - RNA, 61 nt, Human
aggugauccaccugccucagccucccaaagugcugagauuacaggcaugagccaccacgcc

SEQ ID NO: 4066 - RNA, 61 nt, Human
aggugauccaccugccucagccucccaaagugcugagauuacaggggugagucaccgcgcc

SEQ ID NO: 4067 - RNA, 61 nt, Human
aggugauccaccugccucggccucccaaagugcugagauuacaggcgugagccaccgugcc

SEQ ID NO: 4068 - RNA, 61 nt, Human
aggugauccaccugccucugccucccaaagugcugagauuacaggcauaagccagugcacc

SEQ ID NO: 4069 - RNA, 61 nt, Human
aggugauccacuugccucggccucccaaagugcugagauuacaagugugagccaccacgcc

SEQ ID NO: 4070 - RNA, 61 nt, Human
aggugauccgcccgccucagccucccaaagugcugagauuacaggugugagcuaccgcacc

SEQ ID NO: 4071 - RNA, 61 nt, Human
caaaaaggaaauagguguauggauaugugauuuugagauuaaaguuagucuuaaaauguaa

SEQ ID NO: 4072 - RNA, 62 nt, Human
caaaacccagugcccugguuuuuccccacccgagaugaaggauacgcuguauuuuuugccua

SEQ ID NO: 4073 - RNA, 63 nt, Human
caaaacgaaagugcuucucaucaaugauauguaaggugacuuaugaaucaccugaguacaauu

SEQ ID NO: 4074 - RNA, 64 nt, Human
caaaacuaacugaauuuaagcuucaggucccuuuguaugcaguagaaaggaauuauuaaaaaca

SEQ ID NO: 4075 - RNA, 62 nt, Human
caaaacuguauugaaaaaauauuguuuaaugcaaaugaaggaaugcaauaaagaguaaauau

SEQ ID NO: 4076 - RNA, 62 nt, Human
caaaacuuuugccucccuaguucaagcgauucuccuaccucagccuccugaguagcugggau

SEQ ID NO: 4077 - RNA, 62 nt, Human
caaaagccccgggaucuguuugguagcaggagaaaugaaggaagaugaaaaagcaggcaggg

SEQ ID NO: 4078 - RNA, 63 nt, Human
caaaaggcagaaggagggagaccccaaaaagaguuacacuggaagaagagccccuccuuccuu

SEQ ID NO: 4079 - RNA, 64 nt, Human
caaaaggucauugguggcagaguggauucuugaacaaacuggaaaguacguuaugauagugucc

SEQ ID NO: 4080 - RNA, 63 nt, Human
caaaagucuguaaacuggucuguuugccaaagugaacacuggaugacuaaggagcugaagaag

SEQ ID NO: 4081 - RNA, 63 nt, Human
caaaagugacauauugucuauuacaugggcccaaucaguauuaaaguacuccccuuacucaaa

SEQ ID NO: 4082 - RNA, 62 nt, Human
caaaauaucuuuaaaaguuaaaacauccagauauauaagcuauuuuuuccuaaggauaaagu

SEQ ID NO: 4083 - RNA, 61 nt, Human
caaaaugacuccauauuucaaauaucuguuuagacugugaaggccaaauaauuuuuaagaa

SEQ ID NO: 4084 - RNA, 61 nt, Human
caaaauggcaacuucccacagccacauuucagaccugcugagacugcugagugaggaaugg

SEQ ID NO: 4085 - RNA, 62 nt, Human
caaacaaaaaaaacuguuaucgaacuuucuuuguugcugcuaguuaaaacuuguugcaacuu

SEQ ID NO: 4086 - RNA, 62 nt, Human
caaacaacaaagcagaagacuccucucuucugacuguuuacaccuuuccgugccgggagcgc

SEQ ID NO: 4087 - RNA, 63 nt, Human
caaacaacaucaccgugaauuggccuuuccugaaagugacuuaucugacacaucucuguagcc

SEQ ID NO: 4088 - RNA, 64 nt, Human
caaacaagauacauguguaauuaaagacccuuauggaacuggaagacgucuuguagugcuacau

SEQ ID NO: 4089 - RNA, 62 nt, Human
caaacaauggaagaacuugcauuuuuauggaacucaguauuaaaagaaaaauauaaugugaa

SEQ ID NO: 4090 - RNA, 62 nt, Human
caaacaucuucuggcauauggcuuguuaauguuguguuuacacuaacugccaaaaugugccu

SEQ ID NO: 4091 - RNA, 61 nt, Human
caaacccucacugagcaccucugauguugagcaccugcugaauacugagcacugaaugggg

SEQ ID NO: 4092 - RNA, 62 nt, Human
caaacccucaugacaaaguaggcacaagucuacaauaagcuaaaucagaauuuacaaauaca

SEQ ID NO: 4093 - RNA, 63 nt, Human
caaaccuauuaaaaaugauacuuagacagaauugucaguauuauucaagaacauuuaggcuau

SEQ ID NO: 4094 - RNA, 62 nt, Human
caaaccuggauucucaagaugaaugcucuuucauucaucucaguaaaacaaagccuaaaaca

SEQ ID NO: 4095 - RNA, 64 nt, Human
caaagaaccaaagaagaaaguccacccuugguuccuaacuggaaucagcucaggacugccauug

SEQ ID NO: 4096 - RNA, 61 nt, Human
caaagaccacaaguuucagagcauggagacauuccugcugaaucgccuucucaccuccucg

SEQ ID NO: 4097 - RNA, 62 nt, Human
caaagacccaaagcugucagaaaacacuggauaaaugaaggaguaaguuaucaggccuuauu

SEQ ID NO: 4098 - RNA, 62 nt, Human
caaagacuauuucauucuguuguauucagaguauucaucucacuacauugauuuguuugugg

SEQ ID NO: 4099 - RNA, 62 nt, Human
caaagagaccagauaaaaaguuuggagcugaaaagugcaauaacugaaaugaaaaauucacu

SEQ ID NO: 4100 - RNA, 63 nt, Human
caaagagaugugaggguaaggggaaagccaaagcuacacuggaggaauuuuuauagccuuuga

SEQ ID NO: 4101 - RNA, 62 nt, Human
caaagaggaauguaauguaaagugaaauaaaacuauaagcuauguugcggaaaguggaacga

SEQ ID NO: 4102 - RNA, 62 nt, Human
caaagcaggucugaagaggagacuaccaaagcaguguuuacaaacccagaguccacacaacc

SEQ ID NO: 4103 - RNA, 62 nt, Human
caaagccagagguguaauguugguuauaugaaguucaucucaaaauggagaccaugaccaga

SEQ ID NO: 4104 - RNA, 62 nt, Human
caaagcgaugucagagggcgguuuugagcuuucuauaagcuauagcuuuguuuauuucaccc

SEQ ID NO: 4105 - RNA, 64 nt, Human
caaagcgcuggucccugagugccauucagauugcagaugcaguauuuuacgugauguuuagagu

SEQ ID NO: 4106 - RNA, 64 nt, Human
caaagcuaauuuuuuuuacaugucaauauuggcacaaacuggaaugaaagaauaguuugauuca

SEQ ID NO: 4107 - RNA, 62 nt, Human
caaagcugacauuuagaagagaugcuggugauagucaucucauccuacucaauuuuucaaag

SEQ ID NO: 4108 - RNA, 63 nt, Human
caaaggaaaucgccuagcuccaggcuguguuaggacaguauuagcaugaaggcugugcgacca

SEQ ID NO: 4109 - RNA, 61 nt, Human
caaaggaacuucaggaaauaagcauuucuaaugacugugaaaagcugcaauauuuccaaug

SEQ ID NO: 4110 - RNA, 61 nt, Human
caaaggggagacuccugaagaaaggcggugaagacugugaagagcgggucaggaagaugag

SEQ ID NO: 4111 - RNA, 62 nt, Human
caaagugaauuuuccaugaauguuuuuaauauucucaucucaacauugugauauaugcuacu

SEQ ID NO: 4112 - RNA, 62 nt, Human
caaaguuucuggauguuuuauuaaauauuguacguguuuacaguugggaauuuaaaauaaua

SEQ ID NO: 4113 - RNA, 62 nt, Human
caaauaacuguuugagaucuuaaaacagaaaauccaguguuaaugggcucuagaucuuaaac

SEQ ID NO: 4114 - RNA, 64 nt, Human
caaauaagagaaagauggguugcuagaggaugguagaacuggaagcaaggcagcuaccuuuuug

SEQ ID NO: 4115 - RNA, 62 nt, Human
caaauagauucuuaaaguggcuuucaacuucaagaugaaggagcuuaauaaugguuacucau

SEQ ID NO: 4116 - RNA, 64 nt, Human
caaauauucauaggagcuuuauuuguaauagccccaaacuggaaacaacccagauguccuacaa

SEQ ID NO: 4117 - RNA, 62 nt, Human
caaauauuuuagauauagauuguuuuugugauguaugaaggaaauguuauguuuaguucuuu

SEQ ID NO: 4118 - RNA, 61 nt, Human
caaaucagccuucagguuucccacagcauggccccugcugacacgagaacccaaaguuuuc

SEQ ID NO: 4119 - RNA, 62 nt, Human
caaaucguagcguuuguuaccagagguugugcacuguuuacagaaucuuccuuuuauuccuc

SEQ ID NO: 4120 - RNA, 62 nt, Human
caaaucuauuuagagaaacagcuggcccugcaaauguuuacagaaaugaaauucuuccuacu

SEQ ID NO: 4121 - RNA, 61 nt, Human
caaaugaacccagaauggaacaguggggagcuaacugugaaugaggagaguaccugcugca

SEQ ID NO: 4122 - RNA, 62 nt, Human
caaaugacuacacuaagccuaauaauacaagcuccaguguuauacaauaacccaucagugau

SEQ ID NO: 4123 - RNA, 63 nt, Human
caaaugcacaaucuuuuucccauugaaaugucaucacacuggaaauuguacuauauguaaaaa

SEQ ID NO: 4124 - RNA, 62 nt, Human
caaaugucuuuagguugaaggaauuaccuaugucaugaaggaccugucugugguuuuucaau

SEQ ID NO: 4125 - RNA, 63 nt, Human
caaaugugaaucguauuauuuuaaaaaguggcagagugacuuaacugaucaugcaugaucccu

SEQ ID NO: 4126 - RNA, 61 nt, Human
caaauucuggguccauaaacaacccccaaagucccugcugauccaguagcccuggagguuc

SEQ ID NO: 4127 - RNA, 62 nt, Human
caaauugcuaaauuccaaacagaaccagugacuuugcugcuacauauuuacuaaauugacca

SEQ ID NO: 4128 - RNA, 62 nt, Human
caacaaagcauaaaaaagauucaugcuugguuuuauaagcuauuuugaaauauaaguaucau

SEQ ID NO: 4129 - RNA, 61 nt, Human
caacaacaaaggccuguguuaauguuaaauagaugagauuauggaauguguauauuaaugu

SEQ ID NO: 4130 - RNA, 64 nt, Human
caacaagaugagcuaaucgaaaagcccaugucuccuaugcaguacgcacgaucuggucugggaa

SEQ ID NO: 4131 - RNA, 62 nt, Human
caacaaugaaaaccaacaccaacucaacaacaaagugcaauacaggcugaaccuggcccaac

SEQ ID NO: 4132 - RNA, 61 nt, Human
caacacucccccccuccuuugaucggaauauguacugugaagaguagggguggggaggugg

SEQ ID NO: 4133 - RNA, 63 nt, Human
caacagagucagcugcuaacugauuuccuauaagcacacuggauuaagggcagccacaguggu

SEQ ID NO: 4134 - RNA, 64 nt, Human
caacaggugcuccccugugcuguuacuccuucugccaacuggaagcagauggugaccaggcucu

SEQ ID NO: 4135 - RNA, 64 nt, Human
caaccaagaauguuaugugcaaguuuaucaguaaauaacuggaaaacagaacacuuauguuaua

SEQ ID NO: 4136 - RNA, 62 nt, Human
caaccaugcacuccacaaaggggagcauuuggaaaugaaggacuagcuccuauguaucaggu

SEQ ID NO: 4137 - RNA, 64 nt, Human
caaccaugcugugaucggugcaagucaagaacucuuaacuggaagaaauuguauugcugcguag

SEQ ID NO: 4138 - RNA, 62 nt, Human
caacccugggggccaguucaggugguccccaaccauaagcuaggucugaaaguuacacagcc

SEQ ID NO: 4139 - RNA, 61 nt, Human
caacgaucugcccaccuuggccucccaaagugcugagauuacaggcgugagccacugugcc

SEQ ID NO: 4140 - RNA, 61 nt, Human
caacgauugucuugucucagccuccugaguagcugagauuauaagcacgcaccaucauacc

SEQ ID NO: 4141 - RNA, 64 nt, Human
caacggccuggcagaggagcccaagggacugaagauggccaguagcuggguccugaggccccug

SEQ ID NO: 4142 - RNA, 61 nt, Human
caacgucccagcagucuugguaaaaggagggagccugcugagccaggagggagaaaagaag

SEQ ID NO: 4143 - RNA, 62 nt, Human
caacuaaccuugugaaucuuuugcaguguacugugugcaauaccaagggcauagcucccugu

SEQ ID NO: 4144 - RNA, 62 nt, Human
caacuauauucccaucccucuauuuuaaucuguuaugaaggaagguaaauaaaaaugcuaaa

SEQ ID NO: 4145 - RNA, 64 nt, Human
caacuccugccucuaaggaugucugagcuccccucuggccaguacugcccaccucuaccuuguc

SEQ ID NO: 4146 - RNA, 62 nt, Human
caacuuagaaucugugauugcuuacaggaagaagauaagcuacuaauagaaaauguuuuuac

SEQ ID NO: 4147 - RNA, 62 nt, Human
caacuucaaaucugugauugcuuacaggaggaagauaagcuacuaauugaaaaugguuuuua

SEQ ID NO: 4148 - RNA, 62 nt, Human
caacuugagaagacauuuauaauacaaauaacugaugaaggauucauaaucacaaauauaga

SEQ ID NO: 4149 - RNA, 62 nt, Human
caacuuucaguuggcucugugucaguuuuccauucaguguuaacuacuuguuacugccaugc

SEQ ID NO: 4150 - RNA, 62 nt, Human
caacuuuguaccuugauugccuuacaaaguuauuuguuuacaaacagcgaccauauaaaagc

SEQ ID NO: 4151 - RNA, 53 nt, Human
caagaaacuaauuuuuuaaaagagaacacuggacaacauuuuacuacugaggg

SEQ ID NO: 4152 - RNA, 62 nt, Human
caagaacaaugccauuugagagugagguggucccugcugcuacgaggccauuguacuguuuu

SEQ ID NO: 4153 - RNA, 62 nt, Human
caagaacugcauggaccuaacauucgaucucauucaguauuaaaggggggagggggaggggg

SEQ ID NO: 4154 - RNA, 63 nt, Human
caagaacuggucagaccuugcgaguuuauuuguaaacacuggacagauggaguuaaaaagagc

SEQ ID NO: 4155 - RNA, 62 nt, Human
caagaagccucggcuccugcacggcacccugaucaugaaggacagcaacuuccggcuggugu

SEQ ID NO: 4156 - RNA, 62 nt, Human
caagacacaacuauuaagacgaugaaggcaucgacaguauuaaugucaggugaucugaaaua

SEQ ID NO: 4157 - RNA, 63 nt, Human
caagacgguuaauuacagcccgagaagaacguuaacaguauuaauucuaaccacaaaggagga

SEQ ID NO: 4158 - RNA, 56 nt, Human
caagaucucaucccugugaggggguaggccugcugauucagaggguccucuucauu

SEQ ID NO: 4159 - RNA, 62 nt, Human
caagaugugcucucagaauggccgggcccaagagaugaaggaaaggagugaaagggaaguag

SEQ ID NO: 4160 - RNA, 63 nt, Human
caagcaaauggcaacaacuuagaagaaaucauuuagugacuuaauucuuucuaaagaugaaau

SEQ ID NO: 4161 - RNA, 61 nt, Human
caagcacacuugauuccucacugugcuucagaaugagauuaagaucagauguuggaacgug

SEQ ID NO: 4162 - RNA, 62 nt, Human
caagcccagaagcugcccuggccucuccagaccguguuuacaguguuugcauguagaaugua

SEQ ID NO: 4163 - RNA, 62 nt, Human
caagccucaaauuuuugugcucagaugauccuuuucaucucagccuccugauuagcugggac

SEQ ID NO: 4164 - RNA, 61 nt, Human
caagcugacauauuucccuaaggcuaacaacacccugcugaagcucuuugucaaauaggua

SEQ ID NO: 4165 - RNA, 61 nt, Human
caaggacgucugcuuccaccucaagcgcacagcccugcugagccacauggccggcucugug

SEQ ID NO: 4166 - RNA, 61 nt, Human
caaggaguugaaaagauuaaugucccaaccugaugagauuacggccuugagacaauaaggu

SEQ ID NO: 4167 - RNA, 62 nt, Human
caagggggauuagaguggccuggccccucccccucuaccucaguagcccccaggccugagau

SEQ ID NO: 4168 - RNA, 64 nt, Human
caagggugugguuaguggaggcucugugcugcacguaugcaguauccuaucucuuucuacauca

SEQ ID NO: 4169 - RNA, 63 nt, Human
caagguagguguuugauuagaacacauuuaaacaucaguauuaugaaaacuuguacuuuuugc

SEQ ID NO: 4170 - RNA, 61 nt, Human
caagguccaugugggagggaccaacccagaugcccugcugagugucccugaaaccauggca

SEQ ID NO: 4171 - RNA, 62 nt, Human
caagguuacuucaucuucauucauuauuaccugacaguauuaaacuacuacucaauaauuuu

SEQ ID NO: 4172 - RNA, 61 nt, Human
caagguucucaacacugacuacaugcuggaaugacugugaagcuuuuaaaaaauguuagug

SEQ ID NO: 4173 - RNA, 62 nt, Human
caaguagcacugaguuucuuaggaaauuugucuucaguauuaggucuccaacucuuguaaaa

SEQ ID NO: 4174 - RNA, 62 nt, Human
caagucacaaguuugaaaaccuguauaaugcugaucaucucaaguacccucugccuucaauc

SEQ ID NO: 4175 - RNA, 63 nt, Human
caagucuaucccgcaaagggcagggaauagaggguacacuggaaagaauuugaaaacaauaau

SEQ ID NO: 4176 - RNA, 62 nt, Human
caagucuauguuaaaguugcuuuccugcuguuaaauaagcuaugauauuaagauauucugac

SEQ ID NO: 4177 - RNA, 64 nt, Human
caaguguagaggcugccucugugugugguuuaaguaaacuggaaaugagacauugacgugcugc

SEQ ID NO: 4178 - RNA, 62 nt, Human
caaguucugucagacuccaucucccccagguucaaugaaggauaauaaucuaaaucauuagg

SEQ ID NO: 4179 - RNA, 62 nt, Human
caaguugcuuuccucacucccugucaugagacuucaguguuaauguucacaauauacuuucg

SEQ ID NO: 4180 - RNA, 64 nt, Human
caauaaacuuagaacauaugcauuaauacuaaaccuaugcaguaauaccauaauuagccuucua

SEQ ID NO: 4181 - RNA, 63 nt, Human
caauaaucugggguugaaacuuugaggaaaugccagugacuuauuccagagugccucaguuag

SEQ ID NO: 4182 - RNA, 64 nt, Human
caauacacacugauauauacauguugaaguaaugguaugcaguaagauuuuuuuuaauccuauu

SEQ ID NO: 4183 - RNA, 61 nt, Human
caauacgauuauucaauguggugacugggguagacugugaagcagcccuccuuaugcccac

SEQ ID NO: 4184 - RNA, 62 nt, Human
caauacuucaauacuucauuuaaaauauuuuuaugugcaauaaaauguauuuguuuguauuu

SEQ ID NO: 4185 - RNA, 62 nt, Human
caauagccauaauuuuaccagccuuucugucauaugcugcuauuacaaaguggaagcuguug

SEQ ID NO: 4186 - RNA, 63 nt, Human
caauauauuuugaccuuaccauuauuccagagauucaguauuaaaaaaaaaaaaauuacacug

SEQ ID NO: 4187 - RNA, 64 nt, Human
caauaugcaguagcuuuaagccauucaagcuccauuaugcaguauaucugagaagggaaaggaa

SEQ ID NO: 4188 - RNA, 64 nt, Human
caaucacuguguccacaugagcgaaccccagcacguggccaguaucaucagcuccuucuuacag

SEQ ID NO: 4189 - RNA, 62 nt, Human
caauccaagauuagacuacacaaaagcuuccuuccaguauuaaacaaaaagaauuaaacaua

SEQ ID NO: 4190 - RNA, 64 nt, Human
caaucuacugugguuuuacuauguaaggugaaaauuaacuggaacgauguuuguuugcuauacu

SEQ ID NO: 4191 - RNA, 62 nt, Human
caaugacucguauucagaugcuuaaagaaagcauugcugcuacaaauauuucuauuuuuaga

SEQ ID NO: 4192 - RNA, 62 nt, Human
caaugacuuuauugcaucuggguagcuguaaggcaugaaggaugccaagaaguuuaaggaau

SEQ ID NO: 4193 - RNA, 62 nt, Human
caaugaguuauggagacucgaggguucaugcagucaguguuauaccaaacccaguguuagga

SEQ ID NO: 4194 - RNA, 62 nt, Human
caaugauaaagggauaaaacaguauacugacaacuguuuacaagaaaguggagaaaaaugua

SEQ ID NO: 4195 - RNA, 62 nt, Human
caaugaucuuuucucauuucagggcucuucucaaauaagcuaaaagaaaaaggaucaggaga

SEQ ID NO: 4196 - RNA, 62 nt, Human
caaugcaggacucaucacaucuauucggauauucuguuuacacacccaugucaucccagaga

SEQ ID NO: 4197 - RNA, 62 nt, Human
caaugccagaauguaagaguugcaagugauuuugugcugcuauucauuaaaacuuguauucc

SEQ ID NO: 4198 - RNA, 62 nt, Human
caaugcucucagugucugccccaaguaccaccucaugaaggaugccacugcuuucugugcag

SEQ ID NO: 4199 - RNA, 64 nt, Human
caauggaacaagacuaaccuauuuagaaacauuuagaugcaguauuuuacauacaguucugguu

SEQ ID NO: 4200 - RNA, 62 nt, Human
caauggcauaagaaguugacaaaaauuucuuaaagugcaauagauuuucaaguguauugugc

SEQ ID NO: 4201 - RNA, 64 nt, Human
caauggucauuggaaauacaaauuaugauuggaaggaacuggaaaagaauacagaauacaaagg

SEQ ID NO: 4202 - RNA, 64 nt, Human
caaugucugcaucugugcuguguguguagugugguuggccaguaggugaguaucccugugugug

SEQ ID NO: 4203 - RNA, 62 nt, Human
caaugucuggggauauuucuggcuaucacagcuuaugaaggagguugcuacuggcaucuagc

SEQ ID NO: 4204 - RNA, 61 nt, Human
caauuaccuuuucccggauuccagggaauucauacugugaaaucaaaaccauguuguuuug

SEQ ID NO: 4205 - RNA, 61 nt, Human
caauuauucugaugcugggacaggugagaagaaacugugaaguauaugagccuuugaaagu

SEQ ID NO: 4206 - RNA, 61 nt, Human
caauuauuuuaauccagcuaagauguggccaacacugugaaauacaggagauguuaagguu

SEQ ID NO: 4207 - RNA, 62 nt, Human
caauucuguaaguggugacuuuuugagcaccuuucaguauuauguauuuguaaaaaccauug

SEQ ID NO: 4208 - RNA, 62 nt, Human
caauuuauaaagacaaaucuaugaaugaauuuuucaguguuaucuucauaugauaugcugaa

SEQ ID NO: 4209 - RNA, 61 nt, Human
caauuuuauagcacagaauccuacgaagauaggacugugaacauuuguuuucuuuuucgug

SEQ ID NO: 4210 - RNA, 62 nt, Human
caauuuuuuuuuuuuuaagcucaucagcuaucgucaguguuagcauauuuuaugugcggccc

SEQ ID NO: 4211 - RNA, 62 nt, Human
cacaaaauuaugcaaauauuuuaauguuuauuaauguuuacaguggaauugugaauaaguuu

SEQ ID NO: 4212 - RNA, 61 nt, Human
cacaaagaagguguggccagaacaacuugggcuccugcugaccaauguccucuagggccua

SEQ ID NO: 4213 - RNA, 64 nt, Human
cacaaauagaacaaagggaggaaaggaaaaaucaauaugcaguaaagaggaggaagggagcccg

SEQ ID NO: 4214 - RNA, 62 nt, Human
cacaaccucuaccuccaggguucaagcgaugcuccuaccucagccuccucaguagcugggau

SEQ ID NO: 4215 - RNA, 61 nt, Human
cacaacuggaauagcuaauuacagucuauuaaaacugugaauguauguagcaauccugcgu

SEQ ID NO: 4216 - RNA, 61 nt, Human
cacaauguaccaaacaaggcauaagcagcuucuccugcugacuggccaaucacugcccauc

SEQ ID NO: 4217 - RNA, 62 nt, Human
cacacaucuuuggacuuuucuuaaaaguucaguaauaagcuaacuguguuuauaaaauguaa

SEQ ID NO: 4218 - RNA, 63 nt, Human
cacacaugcgcgugcgcacacacacaaacacacacacacuggacaguagaugggccgacacac

SEQ ID NO: 4219 - RNA, 63 nt, Human
cacaccagggaccaggggugcccaggcaccccccaacacuggaugcaaugguguuacacugga

SEQ ID NO: 4220 - RNA, 62 nt, Human
cacacccacccuggcuuccaucaugagugcagugucaucucagcgggaggaagggcuaauuu

SEQ ID NO: 4221 - RNA, 64 nt, Human
cacacccaggcuugugcggggccaggcugggagcccaugcaguagggcagaaggcagcggaggc

SEQ ID NO: 4222 - RNA, 64 nt, Human
cacacccuccaauucacacugccuucuaguugugccaacuggaaccacccuuuggcugugcugc

SEQ ID NO: 4223 - RNA, 61 nt, Human
cacaccugcgagggggcaggugugcuccgccgcccugcugauaagcuggcuucauuaaacu

SEQ ID NO: 4224 - RNA, 64 nt, Human
cacagacacacacugcuaaaugugaagauggaacuaaacuggaaauuaaauuauacugacaaua

SEQ ID NO: 4225 - RNA, 62 nt, Human
cacagcagccagaagugaccagcauucuugugaauguuuacauccugcugcugauagguuca

SEQ ID NO: 4226 - RNA, 62 nt, Human
cacagcauagcugaaaguugccaaacuggacauugugcaauaaaguagaauucuauauugau

SEQ ID NO: 4227 - RNA, 61 nt, Human
cacagccuuccuucugcucccaccccagaaaucacugugaaauuucaugauuggcuuaaag

SEQ ID NO: 4228 - RNA, 62 nt, Human
cacagcuucuauuggacauauuuucuuuuuaggaaugaaggaaaauucucccauuuuugagc

SEQ ID NO: 4229 - RNA, 61 nt, Human
cacagcuuuugguaacaaauaucgcuaaaccuuacugugaauuuaggcaucucuggcaugc

SEQ ID NO: 4230 - RNA, 64 nt, Human
cacaggugucgcccagguuucguaaccuccacuuuaaugcaguaagccgcaagaaugacuucug

SEQ ID NO: 4231 - RNA, 64 nt, Human
cacaguugaaauucauggaacuggcauuauuuaagcaacuggaauuccacacuguaggaagguu

SEQ ID NO: 4232 - RNA, 53 nt, Human
cacaguuggagguaacuagggauuucuaccucaaccgcgagaccuaugcaagg

SEQ ID NO: 4233 - RNA, 64 nt, Human
cacauaaagccaugcuguuuuuggucaaacuguguaaacuggaaaaauucacaucauuucugag

SEQ ID NO: 4234 - RNA, 64 nt, Human
cacauaaaggaaucucucuccuuggacucagccccuaacuggaagcaagagccacugcccucug

SEQ ID NO: 4235 - RNA, 62 nt, Human
cacauaacauuguaugcauggaaacauggaggaacaguauuacaguguccuaccacucuaau

SEQ ID NO: 4236 - RNA, 63 nt, Human
cacauagcucuaaugacauauguaugaaaaaccauacacuggaugaccuagucgauuauuuaa

SEQ ID NO: 4237 - RNA, 61 nt, Human
cacaucauuuaaaguaaaaaaaaaccuccaacaacugugaauuuauaguuuaagagugauu

SEQ ID NO: 4238 - RNA, 62 nt, Human
cacauccaccucccccuggccaccuacgcccuggucaucucagccaagaaggccuaccauga

SEQ ID NO: 4239 - RNA, 63 nt, Human
cacaugcugacacagacucacucagagacccuuagacacuggaccaggccuccucucagccuu

SEQ ID NO: 4240 - RNA, 61 nt, Human
cacauuauagcauuuuuacccuaaacaugauguugagauuauuauauacuguauuuucuuc

SEQ ID NO: 4241 - RNA, 62 nt, Human
cacauuguucauuuacauagguaaaauauuacucuguuuacagcaaaaggcuaccucauagu

SEQ ID NO: 4242 - RNA, 62 nt, Human
cacauuuccacuauaauuuuacaaaguuaaauuuauaagcuagcauuaaguaaagugaaguc

SEQ ID NO: 4243 - RNA, 62 nt, Human
caccaaacucuugucuauauuuaccuuuguaccacaguauuaaucgcuauuguucauguauc

SEQ ID NO: 4244 - RNA, 63 nt, Human
caccaaaucacagauucaggaggaauuuggcuuucacacuggacucagauaccuucuucagug

SEQ ID NO: 4245 - RNA, 64 nt, Human
caccaacacaggaagaaauagaagucaccuauugaaaacuggaauggcccauucagaaagacag

SEQ ID NO: 4246 - RNA, 61 nt, Human
caccacacucacucaccagcucuggggaaagcuacugugaacuaggagcaggauuccuggg

SEQ ID NO: 4247 - RNA, 62 nt, Human
caccacacuccaaccuguguaacagagugaggccucaucucaaaaaaaaaaaaaggccacaa

SEQ ID NO: 4248 - RNA, 62 nt, Human
caccacccacaaaagaucccagcugucaguggucucaucucauuagugaggaaagccaagcu

SEQ ID NO: 4249 - RNA, 61 nt, Human
caccaggggcagacccugucgcugcguuucugaacugugaaggagcccauucgggugggag

SEQ ID NO: 4250 - RNA, 63 nt, Human
caccauccaauaaugaguaauagcacaaaguaaaagugacuuaauuugaaauuacuucuguuu

SEQ ID NO: 4251 - RNA, 62 nt, Human
cacccaaagaauuuucaaaggaaaggguguuauagugcaauagcaauuaaaauauaucaaau

SEQ ID NO: 4252 - RNA, 62 nt, Human
cacccauggcccccacccacggaaggacuugaguuguuuacaagcccugcacugaggcagau

SEQ ID NO: 4253 - RNA, 64 nt, Human
caccccagaaagugggaauuugauuuuauccuuccgaacuggaagaacauuuuuaugaagaauu

SEQ ID NO: 4254 - RNA, 51 nt, Human
caccccagcauauuuuuagggccucaucucagugccuaugaggggccugcc

SEQ ID NO: 4255 - RNA, 62 nt, Human
cacccccaaacccccaucccuuccccaccuccagcaguauuacuuguaacgcaauucaggga

SEQ ID NO: 4256 - RNA, 61 nt, Human
caccccucucagugcaccuggggaucccccuaaacugugaauucugcccuggacagggcuu

SEQ ID NO: 4257 - RNA, 62 nt, Human
caccccuucucccuagcaccuaaguguucccucuugcugcuagugcugccuggagguuuggc

SEQ ID NO: 4258 - RNA, 64 nt, Human
cacccguucaccuucuugguugaaguuguguuaacaaugcaguagccagcacguucgaggcggu

SEQ ID NO: 4259 - RNA, 63 nt, Human
cacccuuaugagaagugaagguuuuguaaacuuuccaguauuaauuugggcggguauuccccg

SEQ ID NO: 4260 - RNA, 63 nt, Human
cacccuugcucuccaauuaggcccacguggcauuucaguauuauuaagucagggaaggagccc

SEQ ID NO: 4261 - RNA, 61 nt, Human
cacccuuuacaugauguagggaccagugucuugugagauuaaccuugggacacaguggguu

SEQ ID NO: 4262 - RNA, 62 nt, Human
caccgcgcagcgugacugugaguugcucauaccgugcugcuaucugggcagcgcugcccauu

SEQ ID NO: 4263 - RNA, 64 nt, Human
caccgugcugggggcuccugcugaugcuccugucugggccaguaaaucuuuggaacaugugggg

SEQ ID NO: 4264 - RNA, 62 nt, Human
caccuaacgggaaagaaccgacauggcugccuuuuguuuacacugguuauuuauuuaugacu

SEQ ID NO: 4265 - RNA, 61 nt, Human
caccuauaauccuauuuuaaaucucagagugauccugcugacugccagcaaagguuuguaa

SEQ ID NO: 4266 - RNA, 62 nt, Human
caccucccugguccuugcucuuguuaacccaagaugcugcuacacagaugccaaauggaaau

SEQ ID NO: 4267 - RNA, 62 nt, Human
caccuccuugaaugcuggcgguucauuucaugaucaguguuaagcauuuuccuccaugggaa

SEQ ID NO: 4268 - RNA, 62 nt, Human
caccucuuugggccucaguuuccccaucuguaaaaugaaggaguuggaccaaugcccccucc

SEQ ID NO: 4269 - RNA, 62 nt, Human
caccugccccuucccccuuugcugugacacuucuucaucucacccccccccgccccccucua

SEQ ID NO: 4270 - RNA, 62 nt, Human
caccugggcaauuccuguuuucuaagguggucucugcugcuauuuaacaacccagaguaggc

SEQ ID NO: 4271 - RNA, 62 nt, Human
caccugguaucucgagugccugcaguugcaaguauguuuacaccugguguccaauuuuguau

SEQ ID NO: 4272 - RNA, 62 nt, Human
caccugguuacaacuugcugguggguuuuauguugugcaauacuaggaggaggaggcaggug

SEQ ID NO: 4273 - RNA, 61 nt, Human
caccuugccacccucugucaccuggaggacaucccugcugagacugggacaggcuggagag

SEQ ID NO: 4274 - RNA, 63 nt, Human
cacgcaagcagggacauuuccuagccagcugggggacacuggaaauucgggaaaccaagagag

SEQ ID NO: 4275 - RNA, 61 nt, Human
cacgcacgcacacacacaccugaccaccacccgacugugaacaaaccaacauccgacaaua

SEQ ID NO: 4276 - RNA, 61 nt, Human
cacgccccaccccacucccccagaguacuccccacugugaaaagagcuggaaacuaaacug

SEQ ID NO: 4277 - RNA, 64 nt, Human
cacggcugccgcaagucugcugcagaugaccucaugaacuggaaggggucaaggugacccggga

SEQ ID NO: 4278 - RNA, 64 nt, Human
cacggguaaaaacucuaaaagguuaauuucugucaaaugcaguagaugaugaaagaaagguugg

SEQ ID NO: 4279 - RNA, 64 nt, Human
cacggugcaggcauagcugccugcugcucuggcagaggccaguaaauacaguuccuagaagcag

SEQ ID NO: 4280 - RNA, 63 nt, Human
cacguaucccugugcuggcaccugcucccugugcucaguauuaauuacgcccccuuaacuguc

SEQ ID NO: 4281 - RNA, 62 nt, Human
cacguauuuugcaaaagcuacuuuuccuaguuuucaguauuacuuucauguuuuaaaaaucc

SEQ ID NO: 4282 - RNA, 63 nt, Human
cacgucuccuccauagccccgggaccguguugcuccaguauuaaccucuguggguggccugca

SEQ ID NO: 4283 - RNA, 61 nt, Human
cacgugcgaccuggaggacuggucagaaccguuacugugaaugagugaagauccuggagga

SEQ ID NO: 4284 - RNA, 62 nt, Human
cacguuucauggacuguuaccaacaaagaaaagucaguauuauguuguucucagacacuuug

SEQ ID NO: 4285 - RNA, 63 nt, Human
cacguuuuuguuuuuuuaauguuaaauguguaacucaguauuacugaaaagguacccacauuu

SEQ ID NO: 4286 - RNA, 62 nt, Human
cacuaagaauacaguuugaauguauaaucaguaguguuuacaagauccaacagugcacucau

SEQ ID NO: 4287 - RNA, 62 nt, Human
cacuaaucguuaauaacuauuguauuaaauugucaugaaggaacuuguuuaauaaauggacg

SEQ ID NO: 4288 - RNA, 62 nt, Human
cacuacacuccagccuggaugacagagugagacuucaucucaaaaaaaaaaaaaaacaaaaa

SEQ ID NO: 4289 - RNA, 64 nt, Human
cacuacauaucaguauuuucuaucuguaucuggacaaugcaguagaaauuauaacaaauacaaa

SEQ ID NO: 4290 - RNA, 62 nt, Human
cacuagauugcaaccuguguguuugucaucauccucaucucaccauuguauugcuaugcccu

SEQ ID NO: 4291 - RNA, 62 nt, Human
cacucaacagauguaguugugacaaguauaauaugugcaauaaucauuguuucucuuaugau

SEQ ID NO: 4292 - RNA, 64 nt, Human
cacucugaauguuuaauuaugaaacuuuguagcuauaacuggaaaauuaccugacucuuuguaa

SEQ ID NO: 4293 - RNA, 62 nt, Human
cacucuggccugccugguccucugcguuguagugcuaccucaaucucgggagaaacagcccu

SEQ ID NO: 4294 - RNA, 64 nt, Human
cacucuguagcuuuucuaaaacaguacauuccauucaugcaguagauaugaaggcuuuuuccaa

SEQ ID NO: 4295 - RNA, 63 nt, Human
cacugacaugaucuuagcuucuuuaaucagacuuugugacuuaaaaguuuggggguuuucuuu

SEQ ID NO: 4296 - RNA, 62 nt, Human
cacugaccagcauggacucaggcaacugguaaugauaagcuaugagcuccagugcuuuugcc

SEQ ID NO: 4297 - RNA, 64 nt, Human
cacugauauuuaauccuuaaaaccccuuuaaaugagggccaguauuaucucugcuuucagaagu

SEQ ID NO: 4298 - RNA, 62 nt, Human
cacugcacuccagccuggaugacagagugagaccucaucucaaaugaauagagggguggaga

SEQ ID NO: 4299 - RNA, 62 nt, Human
cacugcauuccagccugggcaacagcgugagacuucaucucaaaaaaaaaaaauuguauuug

SEQ ID NO: 4300 - RNA, 63 nt, Human
cacugcauuuuauucucuuaauacaauguuuucacaacgguuaccuugcuuuccaaagauaaa

SEQ ID NO: 4301 - RNA, 63 nt, Human
cacugccucuccagaaaucaggaguagcaauauuaacacuggacaaagaauuuaaagcaagua

SEQ ID NO: 4302 - RNA, 61 nt, Human
cacugccuucccagcugcccgcaggggguucccccugcugaggagagaccagguggacccc

SEQ ID NO: 4303 - RNA, 61 nt, Human
cacuggagaagcccuggggguggcuggagccagccugcugagaagcguggugcagcugggu

SEQ ID NO: 4304 - RNA, 62 nt, Human
cacuggcguagaaguuuuuguacuguaaagagaccuaccucagguugcugguugcugugugg

SEQ ID NO: 4305 - RNA, 62 nt, Human
cacuggcuggaggaaguggggucuggccuguugauguuuacauggcgcccugccuccuggag

SEQ ID NO: 4306 - RNA, 62 nt, Human
cacuguacuccagcgugggcaacagagcaacacuucaucucaaaaaaaaaaaauauuauaua

SEQ ID NO: 4307 - RNA, 62 nt, Human
cacugugcggggggcaggggugggaggucuaaucuguuuacaaccauuuccgugccaugcuu

SEQ ID NO: 4308 - RNA, 62 nt, Human
cacuuaaaaugacucaauaaaaugacuugcuacguuccguuauucaauuugucauuacugua

SEQ ID NO: 4309 - RNA, 62 nt, Human
cacuuaauguguguccucaucuuuuuacaaauaaaugaaggauuauaaaugaugucagcauu

SEQ ID NO: 4310 - RNA, 62 nt, Human
cacuuauuuuuuaagagggaaaggacuuuggucauguuuacauuggccuuugguuuuuuuuu

SEQ ID NO: 4311 - RNA, 62 nt, Human
cacuucauuugaaaauaaugaaaccauguaccacuguuuacaucaucuguagugauuucaua

SEQ ID NO: 4312 - RNA, 62 nt, Human
cacuucccuagacagccuuuaauaggcaugauaacaguguuaauagaccagugugauagauc

SEQ ID NO: 4313 - RNA, 61 nt, Human
cacuucucaggacacaggccuguguagcugugaccugcugagcucugagaggcccuggauc

SEQ ID NO: 4314 - RNA, 63 nt, Human
cacuugagucguaagccuucuugcuuuugauaacacaguauuauuucucuuacuguagaagaa

SEQ ID NO: 4315 - RNA, 61 nt, Human
cacuuuaauugaaaauguucucuacuaauuaauacugugaaacaaaauugauguuguuuaa

SEQ ID NO: 4316 - RNA, 62 nt, Human
cacuuuaggcaaaugugauggccuccgagcugaaaugaaggaacuggcaaucuuuccaaagu

SEQ ID NO: 4317 - RNA, 64 nt, Human
cacuuuaggcaggaaaacaggaacgcaaggccaggaaacuggaacccagugaauacucagaacc

SEQ ID NO: 4318 - RNA, 61 nt, Human
cacuuucagguugggaguggacccaccccagggccugcugaggacagagcagccaggccgu

SEQ ID NO: 4319 - RNA, 62 nt, Human
cacuuuccacuggaguucacuuucaauugcuucugugcaauaaaaccaagugcuuauaaaau

SEQ ID NO: 4320 - RNA, 62 nt, Human
cacuuuccccaggcuccaguggccuggaugucaauguuuacaaaggggcaaggaccucucau

SEQ ID NO: 4321 - RNA, 61 nt, Human
cacuuuccugcuccucucugucucuagcacacaacugugaauguccuguggaauuaugccu

SEQ ID NO: 4322 - RNA, 62 nt, Human
cacuuugcaugaggagcugaaacugaccaguguccaguguuagcccccacauggggcugcuc

SEQ ID NO: 4323 - RNA, 62 nt, Human
cacuuuuaccuuuaaaguuuacuuguagcaaauauguuuacauugauaaagccagauauguu

SEQ ID NO: 4324 - RNA, 60 nt, Human
cagaaaauccaauccuuaaaaucaacugcuugaugaaggaggcaaaacaaaggcagcagg

SEQ ID NO: 4325 - RNA, 64 nt, Human
cagaaacugagugugagaguugugaaauacaaggaaaugcaguaaagccagggaauuuacaaua

SEQ ID NO: 4326 - RNA, 61 nt, Human
cagaaagcugcucuggggucagcggggaaugugccugcugaaucuguaccugagcuacguc

SEQ ID NO: 4327 - RNA, 61 nt, Human
cagaaauagucccauguauaccuuuuccauauuacugugaacuuucaacuacuaucaagga

SEQ ID NO: 4328 - RNA, 62 nt, Human
cagaaauguugacaauacaacauagcauaugucuucaucucacuaagaaaagagcaguugua

SEQ ID NO: 4329 - RNA, 62 nt, Human
cagaaauguugccauuuuaaugagaugauuuucuucaucucauaauuaaaauaccugacuuu

SEQ ID NO: 4330 - RNA, 62 nt, Human
cagaacauucucaauuaagugauaaguccaaaugaugaaggaaauguuuuaauucacaaaug

SEQ ID NO: 4331 - RNA, 62 nt, Human
cagacacccaggacuuauuuaaacucuguugcaagugcaauaaaucugacccagugccccca

SEQ ID NO: 4332 - RNA, 61 nt, Human
cagacaggcugguauuuaacaggugccucguguugagauuacgcugccuuaauguaacaca

SEQ ID NO: 4333 - RNA, 64 nt, Human
cagacagugaccuccacccccgcagcccucuuaaaaggccaguacucuuggggguggggggagg

SEQ ID NO: 4334 - RNA, 62 nt, Human
cagacaugcagugaaaugguucuuuguuaaaaaugugcaauaaaaauagauuacaauaagua

SEQ ID NO: 4335 - RNA, 62 nt, Human
cagacccaccaugccuggagaggucaggauggaacuaccucauucggcaaauuagccccaaa

SEQ ID NO: 4336 - RNA, 64 nt, Human
cagacccacuuuuucauacacuugcuauauaguaguaugcaguauuuauauuauuccugaaaau

SEQ ID NO: 4337 - RNA, 58 nt, Human
cagacucacacagucuuagaacuaagcugaacacuggaaaaauaauacaugcuuaaag

SEQ ID NO: 4338 - RNA, 62 nt, Human
cagagaacagaaugugucaaggagaagaaucauuuguuuacaaacugaugagcagaucccag

SEQ ID NO: 4339 - RNA, 63 nt, Human
cagagaauccaaguguuagaaggagaacaaaaauucaguauuauacagaucuaaaacucgcaa

SEQ ID NO: 4340 - RNA, 61 nt, Human
cagagacaggagcacaagugggaucugaccuggugagauuauuucugaugaccucaucaaa

SEQ ID NO: 4341 - RNA, 62 nt, Human
cagagauaacacuucccaacucauuuugugaggccaguauuacccuaauagcaaaaccaggc

SEQ ID NO: 4342 - RNA, 62 nt, Human
cagagaugcuucucuuccgugcaccuugauaagcaugaaggacauuccaaaagguaauagcu

SEQ ID NO: 4343 - RNA, 61 nt, Human
cagagauggacaaucguacugggguaaaaaaacccugcugaagagaggacagugaccacag

SEQ ID NO: 4344 - RNA, 62 nt, Human
cagagauuuuuauauuuauacaaaagauuacuaaaugaaggauugcuaaauguuuuugguuc

SEQ ID NO: 4345 - RNA, 63 nt, Human
cagagcaacagcccaguccugaggaugggagggacgugacuuagccuugggauuccacgcucg

SEQ ID NO: 4346 - RNA, 61 nt, Human
cagaggaaauggcacaguuccacaaucucuucuccugcugauggccuucauguuguuaauu

SEQ ID NO: 4347 - RNA, 62 nt, Human
cagaggaucaccagugcauccuucaucacagcaugugcaauaugccaagauuacccucgguc

SEQ ID NO: 4348 - RNA, 62 nt, Human
cagagggucaggguuggaggccugugcuuguguuugcugcuaauguccagcuacagacccag

SEQ ID NO: 4349 - RNA, 62 nt, Human
cagagguuugcaagccucagacaaauaaaugugguguuuacaaugugccuuggcugacuuuc

SEQ ID NO: 4350 - RNA, 64 nt, Human
cagaguauuguauagucaauguuaaauaaaagccaaaacuggaaugugcagaaaguaggcuuug

SEQ ID NO: 4351 - RNA, 62 nt, Human
cagaguguuucgugaucucuccuucuccaucaucucaucucuggaugcuguggugcccagaa

SEQ ID NO: 4352 - RNA, 62 nt, Human
cagauaugguaguuaugaagaaaacaaugucauuugcugcuauuauuguaagagucuuauaa

SEQ ID NO: 4353 - RNA, 64 nt, Human
cagaucaaacgugcuuaagagcuaacucgugacacuaugcaguauuguuugaagaccuguuguu

SEQ ID NO: 4354 - RNA, 63 nt, Human
cagaucuggagaaaugagcaggugucgggaaaugugugacuuaaccguggugagggcuggaaa

SEQ ID NO: 4355 - RNA, 63 nt, Human
cagaugaaugaccaaaaaggaugacacgccagagagugacuuaggaguuaauuugcaucuucg

SEQ ID NO: 4356 - RNA, 62 nt, Human
cagaugagacauauuaacuuagacuaaacgugaacaguauuauauggacucucacaacgcuc

SEQ ID NO: 4357 - RNA, 61 nt, Human
cagaugccucaggaggagaacccuccccaguguacugugaaggaugacacagcacuucuuc

SEQ ID NO: 4358 - RNA, 63 nt, Human
cagauguccucucggcugaagacuggaggaagugaacacuggagugaagaagcggucugugcg

SEQ ID NO: 4359 - RNA, 61 nt, Human
cagauuacagucucuccugaaagggcacagggcccugcugauuguacuuuccccuccugag

SEQ ID NO: 4360 - RNA, 62 nt, Human
cagauuauuugaaucacacaggaugauguguuaacaguauuaggguggaagaggaaucaaga

SEQ ID NO: 4361 - RNA, 64 nt, Human
cagauuuuuuuccccuagauuuugagggagcagagaaacuggaaaaaacuuuagucaauaucuc

SEQ ID NO: 4362 - RNA, 64 nt, Human
cagauuuuuuuguuguuguuagucacaaauacuuagaacuggaaggcucuuuguuauuauugaa

SEQ ID NO: 4363 - RNA, 62 nt, Human
cagcaaaugaccaagcaugaacuaaagguaaagauguuuacagauuacuuuucuuacaaaaa

SEQ ID NO: 4364 - RNA, 62 nt, Human
cagcaagccuuuugaggaagaauggagagucccuucaucucagcagcgguggagacucucuc

SEQ ID NO: 4365 - RNA, 61 nt, Human
cagcaaggaacgaauggacugaacaaaacucagccugcugaggacagaaaccugcccugga

SEQ ID NO: 4366 - RNA, 61 nt, Human
cagcaauaagaaccguccuuggucguggagaguacugugaaacaaaccaaugcacuuacca

SEQ ID NO: 4367 - RNA, 64 nt, Human
cagcaaugcaaauuaugacauagugaauauagaacuaugcaguauuuaagccucaacaauccaa

SEQ ID NO: 4368 - RNA, 61 nt, Human
cagcaauucuccugccucagccucccgaguagcugagauuacaggcgcccgccaccaugcc

SEQ ID NO: 4369 - RNA, 61 nt, Human
cagcaauucuccugccucagccucccgaguagcugagauuauaggcaccuaccaccacgcc

SEQ ID NO: 4370 - RNA, 62 nt, Human
cagcacacaucacaugcaucaacucacaacugagcuaccucauucagcaaagaaccacugag

SEQ ID NO: 4371 - RNA, 64 nt, Human
cagcaccguucauucuaugagucuauuuuucuaaugaugcaguaauuaaauugcaucccaggag

SEQ ID NO: 4372 - RNA, 62 nt, Human
cagcacucgccucccuaccaaugacucaccugaagugcaauacgaaauaaaaggccagcggg

SEQ ID NO: 4373 - RNA, 61 nt, Human
cagcacuggaguuggugagcaugugcucucucuugagauuaggagcuuccuuacugcuccu

SEQ ID NO: 4374 - RNA, 62 nt, Human
cagcacuuuuuuuuuaauggaaaagucuucgguccaguguuacaccuuauaguguaauucag

SEQ ID NO: 4375 - RNA, 64 nt, Human
cagcaggacauuguguguauaguuacaaugcuuccaaacuggaacucuacauuuuguaucuuuu

SEQ ID NO: 4376 - RNA, 62 nt, Human
cagcaggcuccugcaguguguuuauccgugcaucaugaaggacccucauacggcugacgugc

SEQ ID NO: 4377 - RNA, 61 nt, Human
cagcagggaugagaggaaagcagaaaugaaugaacugugaaagcuccuguuuuuauuauca

SEQ ID NO: 4378 - RNA, 62 nt, Human
cagcagggccuggggcugagccugggcugcccauucaucucagcgacuucagccugagaagu

SEQ ID NO: 4379 - RNA, 62 nt, Human
cagcaguuaacugaccuuuuauacaaguuagcacaugaaggauagauaugcacugaaacaug

SEQ ID NO: 4380 - RNA, 61 nt, Human
cagcaguucuccugccucagccucccaaguagcugagauuacaggcgccugccaccccacc

SEQ ID NO: 4381 - RNA, 62 nt, Human
cagcaucaccccuuccuggguggcaugucucucucuaccucauuuuuagaaccaaagaacau

SEQ ID NO: 4382 - RNA, 62 nt, Human
cagcauguccucuaccugugacuucucauuuuccuguuuacacuggggauuuggagggggca

SEQ ID NO: 4383 - RNA, 62 nt, Human
cagcauuguacaauuagcuuaguaacacuauggaauaagcuaaaacauaucacaguuuuuac

SEQ ID NO: 4384 - RNA, 63 nt, Human
cagccaaauccacugcuggccugaacugccccuggacacuggacuuucugcacagugacuggc

SEQ ID NO: 4385 - RNA, 63 nt, Human
cagccaacuagccccugggguggccaccaguaugacaguauuauacgcuggcaacacagaggc

SEQ ID NO: 4386 - RNA, 62 nt, Human
cagccaauccauucacaagcuuggcauugacaugugcugcuaguuuauaaacuggcauugac

SEQ ID NO: 4387 - RNA, 64 nt, Human
cagccacaaagcucauacccagcccuaccaaucaugaacuggaacuccauaaggaggggccaaa

SEQ ID NO: 4388 - RNA, 61 nt, Human
cagccacccccggagaaggccuggucccccacaacugugaacugucuugcccaagccugcu

SEQ ID NO: 4389 - RNA, 62 nt, Human
cagccacuucugaauacaauauguagcugauuuaauaagcuaguuagugaauggaaaauaag

SEQ ID NO: 4390 - RNA, 62 nt, Human
cagccaggcagggugugggggcagcugugccaaucuaccucacaggcccacccccugccggg

SEQ ID NO: 4391 - RNA, 62 nt, Human
cagccauaaaauuguuuaagaaagauuuauauaauguuuacaaaucuggaaucaaggauuuu

SEQ ID NO: 4392 - RNA, 63 nt, Human
cagcccuccgugggcacugccggcgccuugucugcacacuggagguccuccauuacagaggcc

SEQ ID NO: 4393 - RNA, 64 nt, Human
cagcccuggcuaaaggaaugucugaguaacuugugaaacuggaagccucugccucugaaugcau

SEQ ID NO: 4394 - RNA, 62 nt, Human
cagccgguuuggauuacaggccugugcuggaacaucaucucaguuggccaccuuccuggcag

SEQ ID NO: 4395 - RNA, 62 nt, Human
cagccgugcuccugcauuccgucacuccaugacuucaucucagugucacagacagcugccau

SEQ ID NO: 4396 - RNA, 62 nt, Human
cagccucccaaagggcugagauuacaggugugagcuaccucaccuggccaaaacaguuuuuu

SEQ ID NO: 4397 - RNA, 62 nt, Human
cagccugaacagaagcucuuacucuuuccuauuucaguguuaccugugugcuuggucuguuu

SEQ ID NO: 4398 - RNA, 61 nt, Human
cagccuucauuugggcugguuucaucauuuugcacugugaaauagcuuuacagugcauuac

SEQ ID NO: 4399 - RNA, 61 nt, Human
cagccuuguauuggccacaggugcacuaaauugacugugaaucccaaaccuccccagacca

SEQ ID NO: 4400 - RNA, 61 nt, Human
cagcgaauccuucuaguacuaguugagaguuugacugugaauuaauuuuaugccauaaaag

SEQ ID NO: 4401 - RNA, 62 nt, Human
cagcgccucccuccaccccaggacgccacucauuucaucucauuuaagggaaaaauauauau

SEQ ID NO: 4402 - RNA, 63 nt, Human
cagcggugccaggccucaggucagggagaaugucugugacuuagcugcagacuaggagacugc

SEQ ID NO: 4403 - RNA, 61 nt, Human
cagcggugguuccagccuucugauaaucacuggccugcugacacuucccugcaacccaucc

SEQ ID NO: 4404 - RNA, 63 nt, Human
cagcuaacuuuuaaguggauuuugcaaaugaaaaccaguauuacugaguuuuacauacucgaa

SEQ ID NO: 4405 - RNA, 61 nt, Human
cagcucugggaaauuuaauacauuuauauuaauugagauuauuaaaacauuuggacuauua

SEQ ID NO: 4406 - RNA, 64 nt, Human
cagcugcagcaaagccagugagaggugggucucgccaugcaguaaggccacccuggcaccucuu

SEQ ID NO: 4407 - RNA, 62 nt, Human
cagcuggagaaaagaagacaagaaagucuugggcaugaaggagcuuuuugcaucuagugggu

SEQ ID NO: 4408 - RNA, 62 nt, Human
cagcugggaucagccugcagccaucccccgacccugcugcuaggccacggucugcgcccugg

SEQ ID NO: 4409 - RNA, 62 nt, Human
cagcugguaaacugaagagcacaacuauauucuuaugaaggaauuuguaccuuugggguauu

SEQ ID NO: 4410 - RNA, 62 nt, Human
cagcuguuguguaaauacuguauauugcaaaaaucaguauuauuuuaagagauguguucuca

SEQ ID NO: 4411 - RNA, 62 nt, Human
cagcuuuuccaaugaggcuugaauccauuuccucucaucucagcccuaucuucacacaucac

SEQ ID NO: 4412 - RNA, 62 nt, Human
cagcuuuuguuauugguaccuccuaaagggaaaagugcaauauucuugcaucuucaguagug

SEQ ID NO: 4413 - RNA, 62 nt, Human
cagcuuuuuuuauuuugcauuuguuuuuucaauguguuuacauuguaugaauugagcuuuuu

SEQ ID NO: 4414 - RNA, 62 nt, Human
caggaaaauaaguuuugauugcauuguuuuuaaaauaagcuaguuuucugagguguuuucac

SEQ ID NO: 4415 - RNA, 63 nt, Human
caggaaagaaaaucucauuacacaucagaaaauucacacuggagagaaaccuuaugaaugcag

SEQ ID NO: 4416 - RNA, 62 nt, Human
caggaaagugaggagggaaauaauuuugguucuugugcaauaaaaguugaccuugacucucu

SEQ ID NO: 4417 - RNA, 61 nt, Human
caggaacugugugcuaaaauugaacaauuuuuuugagauuaugguugcaauacuuggcgug

SEQ ID NO: 4418 - RNA, 62 nt, Human
caggaaggucauagauggacacuggccauucuggucaucucagucuggaacucagucccacu

SEQ ID NO: 4419 - RNA, 63 nt, Human
caggacagaaaccacuuaguuuuuaauaaguggcucaguauuacaauugcagcgaugccuggc

SEQ ID NO: 4420 - RNA, 62 nt, Human
caggagacacggucccaggcacugcacaggccugcaguauuaccaggcggaggggcugcuuu

SEQ ID NO: 4421 - RNA, 62 nt, Human
caggagacaucaggucccccuggauucaaauuaagugcaauauuuugcaaacagcucuucuu

SEQ ID NO: 4422 - RNA, 62 nt, Human
caggagcuagcccagucccuggagcuguccuucauuccguuaggaauaacacugcagcccuc

SEQ ID NO: 4423 - RNA, 61 nt, Human
caggaggaggagggaauggcaggaaccggacagacugugaacuugccaagagaugcaauac

SEQ ID NO: 4424 - RNA, 62 nt, Human
caggaggguccuggcacuacccagauuuccacagugcugcuaauaucccagcuccagccagc

SEQ ID NO: 4425 - RNA, 62 nt, Human
caggaguuagaauucucucagaagggucuaugaucaguauuacuuuauuaagaauuaccuuu

SEQ ID NO: 4426 - RNA, 62 nt, Human
caggaguugggcugaguuuguguuucuuuguugccaguguuaccuuugcuguaccauagacu

SEQ ID NO: 4427 - RNA, 64 nt, Human
caggaugaggauagcaauggggaaggguugugggcaaugcaguaacagggaaauggcuucagaa

SEQ ID NO: 4428 - RNA, 61 nt, Human
caggauucuggcauuguagacacagaaacaccgacugugaaguuuuauguaauacaaacac

SEQ ID NO: 4429 - RNA, 63 nt, Human
caggcacugggacaucacaggcuucaguaccugaccaguauuaguugcauauaucauugaaca

SEQ ID NO: 4430 - RNA, 61 nt, Human
caggcaguuuuuucuuaaacuacugagaugauaacugugaaauauuugugauacgugucau

SEQ ID NO: 4431 - RNA, 62 nt, Human
caggccacagccccuggcuuugugcccacuuaggcaguauuaucaacaagguccugcucagu

SEQ ID NO: 4432 - RNA, 62 nt, Human
caggcgguuugugcaggaaagcacagugccguguuguuuacagcuuuucuagagcagcugug

SEQ ID NO: 4433 - RNA, 62 nt, Human
caggcuggggaauuuugcugcucccuauugcuucuguuuacaaaaaugaauuuuuccugguu

SEQ ID NO: 4434 - RNA, 62 nt, Human
caggcugggugcauguaucccccuacuccuacccucaucucauccuuaaggcccagagguag

SEQ ID NO: 4435 - RNA, 62 nt, Human
caggcuugauguucacaagagaagagugacaaaaugcugcuaaaauggaaaauaagagagga

SEQ ID NO: 4436 - RNA, 62 nt, Human
cagggacaucaucucuuccaucuuuggguccuuagugcaauaccuggcagcuagccagugcu

SEQ ID NO: 4437 - RNA, 61 nt, Human
cagggauucuccaagcagucauuucagggggcuccugcugaccccgccacucagcagugca

SEQ ID NO: 4438 - RNA, 61 nt, Human
cagggcccacaucaucuaggcuccccagcccccacugugaaggggcuggccaggggcccga

SEQ ID NO: 4439 - RNA, 61 nt, Human
cagggcccaccccugcucugucugguacaggccccugcugagugggccccucuccucugcc

SEQ ID NO: 4440 - RNA, 61 nt, Human
cagggcccuagaagaucacagcagggccuucugccugcugaccauaacagugccagcuucu

SEQ ID NO: 4441 - RNA, 61 nt, Human
cagggccucucggcugauggugcccagcugguuccugcugagguccagcagugcuagggag

SEQ ID NO: 4442 - RNA, 64 nt, Human
cagggcugcaaugcagcauguugcccuggcaccuguggccaguacucgggacagacuaagggcg

SEQ ID NO: 4443 - RNA, 62 nt, Human
cagggcuuugugaucuuuauuuuuagaugaaauagugcaauaauauguguuuucauaaauca

SEQ ID NO: 4444 - RNA, 62 nt, Human
caggggaguaggagaaugucuuccagaaaaauacauaagcuaguuucuguucuguaaaguga

SEQ ID NO: 4445 - RNA, 61 nt, Human
caggguagguccuggggcacugugggccgccugccugcugaugugggcucuaggccagcuu

SEQ ID NO: 4446 - RNA, 62 nt, Human
cagggucacgcccaagccccucuuuguggcaugcucaucucagugcagccccaacugcuucu

SEQ ID NO: 4447 - RNA, 63 nt, Human
cagggucaggcucuuagagcaggcacaagacugggacacuggacagaagguuguucccaugau

SEQ ID NO: 4448 - RNA, 62 nt, Human
cagggucccacccccaacccccagagguggcccuuguuuacagugaggacucggccacugug

SEQ ID NO: 4449 - RNA, 62 nt, Human
caggguucuguaugauggagacuauuauugcuauugcugcuaauuccaugagcugugaagau

SEQ ID NO: 4450 - RNA, 64 nt, Human
cagguaagcagcagcaaggccuugugccuccaaaccaacuggaagcuucaaagcucccaggcug

SEQ ID NO: 4451 - RNA, 62 nt, Human
cagguaauauuuuucuguuugaaguuguuacuuuuguuuacagcaaaguuugauguagugug

SEQ ID NO: 4452 - RNA, 62 nt, Human
cagguagagagaccacaagcaggcucaacauaacauaagcuagaaaaauuagaugacugaau

SEQ ID NO: 4453 - RNA, 62 nt, Human
caggucagcauccucuacuacgggggccaccuugucaucucaggccagaugaccagcggcaa

SEQ ID NO: 4454 - RNA, 61 nt, Human
caggucgguucccgaggccuggccuuucccucuccugcugagaaccagaacccaccaggag

SEQ ID NO: 4455 - RNA, 63 nt, Human
caggucugaagugggaagaaagcuccgaaauagaaaacgguuagguccuauucuauccccagc

SEQ ID NO: 4456 - RNA, 62 nt, Human
caggugaggagaggccuggggauuggggaagcugucaucucaguguuaauaaucaacuugcu

SEQ ID NO: 4457 - RNA, 62 nt, Human
caggugauggaugcuacgaguauaaauggauuaacuaccucaauccuuacaguaagauugga

SEQ ID NO: 4458 - RNA, 61 nt, Human
caggugcacacacucgcucaugcucacacugccccugcugagaucuucccugggccucugc

SEQ ID NO: 4459 - RNA, 62 nt, Human
cagguucucucuuccugaaaagaacugauugcuguguuuacaugaaaugacauuggagucag

SEQ ID NO: 4460 - RNA, 62 nt, Human
caguaaagagggaaaaaaaggaaggauggaaggaaugaaggaaggaagggaggaaggggaga

SEQ ID NO: 4461 - RNA, 64 nt, Human
caguaacacuuuaaaacaagaaucagacauuuuccuaugcaguauuuuuuuuuaaaguuuauuu

SEQ ID NO: 4462 - RNA, 62 nt, Human
caguaacucuccaggacuggaauaucugauugcucaguguuaauaguaguucaugcuguggu

SEQ ID NO: 4463 - RNA, 62 nt, Human
caguaaugauagccuccaaggcagaaacacuuuucaguguuaaguuuuuguuuacuuguuca

SEQ ID NO: 4464 - RNA, 63 nt, Human
caguacuuugcugagugaaaucaccauauagaauucaguauuaacagaucaugcauucagaug

SEQ ID NO: 4465 - RNA, 62 nt, Human
caguagugcuggucacccuccggcaucugugacucuaccucaaggaccacauuucccaaagg

SEQ ID NO: 4466 - RNA, 63 nt, Human
caguaguggcuacaggugcuaagcaaaagucagguacacuggacagagccaugcgauugauug

SEQ ID NO: 4467 - RNA, 62 nt, Human
caguaucacaggccagauguuguuccuggcuagauguuuacauuuguaagaaauaacacugu

SEQ ID NO: 4468 - RNA, 61 nt, Human
caguauuagcaugaaggcugugcgaccaucaugccugcugauccuugaggcaggccugguc

SEQ ID NO: 4469 - RNA, 61 nt, Human
caguauuccuauugcuuuuacuguguuuuagguacugugaagggaucaaaaaaccaaacag

SEQ ID NO: 4470 - RNA, 62 nt, Human
cagucaccaucucaaccuuaugucaccucagcccucaucucaaugcccaaaccccuuacaca

SEQ ID NO: 4471 - RNA, 63 nt, Human
caguccaggcaacugacaugcuuuuauuagucauacaguauuaaugcaggugucaggaaaugu

SEQ ID NO: 4472 - RNA, 61 nt, Human
cagucccaccuguacagccccuccccgcccagaacugugaauggccugcuccaggccaugg

SEQ ID NO: 4473 - RNA, 64 nt, Human
caguccucauuuacuggauuugacuucagccaggugaacuggaaugccuuggggcguggaaggg

SEQ ID NO: 4474 - RNA, 61 nt, Human
caguccugguguggugcugaccacccaaauaugacugugaauuguggaaagggcaguagau

SEQ ID NO: 4475 - RNA, 62 nt, Human
cagucggcgacaagguugugcguggcuccugaccugcugcuaagagucacuugaccagacug

SEQ ID NO: 4476 - RNA, 62 nt, Human
cagucuagccaaaagcucaagugggacaauggcacaguauuaaggucaaggacaaaaacuua

SEQ ID NO: 4477 - RNA, 62 nt, Human
cagucuauaccauagcaauguuuuuccuuuaauccaguguuacuguguuuaucuugauaaac

SEQ ID NO: 4478 - RNA, 62 nt, Human
cagucuuauuuauagugugggaauaauaaugguucuaccucagaaguuaauagaagaaugaa

SEQ ID NO: 4479 - RNA, 63 nt, Human
cagugaaaugcaaaaauauucccguuaucuuugaccaguauuaauuuuugagaucuuacugcu

SEQ ID NO: 4480 - RNA, 62 nt, Human
cagugacaaguggguccaggacuauaucaaggacaugaaggagaacugagugacccagaagg

SEQ ID NO: 4481 - RNA, 62 nt, Human
cagugacuuggacuguaaaugaaacauugcauccaugaaggacagcaccaagcaccuuuuug

SEQ ID NO: 4482 - RNA, 64 nt, Human
cagugccuauaacaagacagagaccucuggucagcaaacuggaacucaguaaacuggagaaaua

SEQ ID NO: 4483 - RNA, 62 nt, Human
cagugcugucuugguagcuuggacuuagugggaguguuuacaccauggaaauugacaaacua

SEQ ID NO: 4484 - RNA, 62 nt, Human
caguggagccugccggcgcaucugaggggcagaaugcugcuagcacuugaaucugggaucuc

SEQ ID NO: 4485 - RNA, 62 nt, Human
caguggcauaggaagacggcaaaaauuuccuaaagugcaauagauuuucaaguguauugugc

SEQ ID NO: 4486 - RNA, 64 nt, Human
caguguggugguaccaggaagaaagaggauuggaaaggccaguacuguuuuaguugcucggcac

SEQ ID NO: 4487 - RNA, 64 nt, Human
caguguucugaucuuguuugugcagagugaacucugaugcaguaucagucuuguccugggagcc

SEQ ID NO: 4488 - RNA, 62 nt, Human
caguuaagacuuguucuuugagugauguauuaaaugcugcuagaaaagccucauuacauuaa

SEQ ID NO: 4489 - RNA, 62 nt, Human
caguuaagucacagcuuaauguguagauaugagcuguuuacaguggugacuauauauaauug

SEQ ID NO: 4490 - RNA, 62 nt, Human
caguuacaauaaauaacuuuaugcagauuaauauauaagcuacacaugauguaaaaaccuua

SEQ ID NO: 4491 - RNA, 62 nt, Human
caguuacacuaacccuuaauuaucuuacuugucuaugaaggagauaaacaggguacuguacu

SEQ ID NO: 4492 - RNA, 62 nt, Human
caguucaaaauauaucugacuguauuucuuugcccuaccucacuauaauccaaagugcacua

SEQ ID NO: 4493 - RNA, 61 nt, Human
caguucagucccuuauucugcccuguuggaagcccugcugaacccucaacuauugacugcu

SEQ ID NO: 4494 - RNA, 62 nt, Human
caguucauacuuaccuaaaauuaaauauaguuuaugcugcuauuguauaaaguagcacaugu

SEQ ID NO: 4495 - RNA, 64 nt, Human
caguucauuagaaugauaacauuuauauggauaaagaugcaguauuccuuauucuguacuugau

SEQ ID NO: 4496 - RNA, 61 nt, Human
caguucuuucuuuaacccuuuuuucuccuauguacugugaacauuuaaaaaguacuuuuaa

SEQ ID NO: 4497 - RNA, 64 nt, Human
caguugaaaauuauggcuguacuauugcuuaaacaaaacuggaacuguuguugaauccauagcc

SEQ ID NO: 4498 - RNA, 62 nt, Human
caguugaaguuuaauagugugaaaaaaauauuucucaucucacuauaucuucuaugggaggc

SEQ ID NO: 4499 - RNA, 62 nt, Human
caguugagucacaagagaagccugucuugauauaucaucucagaaacuuuccugaauaugug

SEQ ID NO: 4500 - RNA, 62 nt, Human
caguugccaaacguugcaggaccgcacggagaagaugaaggagaucguaggguggaugcccc

SEQ ID NO: 4501 - RNA, 63 nt, Human
caguuuacgucuuguauuuuguucugugauggaggacacuggagagaguugcuauuccaguca

SEQ ID NO: 4502 - RNA, 61 nt, Human
caguuucagccagcgcugaggaaaauauauucaacugugaagaagacccuggugauaccuu

SEQ ID NO: 4503 - RNA, 62 nt, Human
caguuucccaaauuugacaggccaccuucaaacaugcugcuaugcaguuucugcaucauaga

SEQ ID NO: 4504 - RNA, 62 nt, Human
caguuucuuccucuguaaaaugaggacauacuaccuaccucaugugguugguugaugauugu

SEQ ID NO: 4505 - RNA, 62 nt, Human
cauaaaaacugaagaacauugaugagaaaucucugugcaauaagggggccaggcacccccac

SEQ ID NO: 4506 - RNA, 63 nt, Human
cauaaaaggcucucugaggcgaggccauuugugucacacuggagaagggauggcaccacccuu

SEQ ID NO: 4507 - RNA, 62 nt, Human
cauaaaaucagaaacuucaagcucucuaaauaaaaugaaggacuauaucuagugguauuuca

SEQ ID NO: 4508 - RNA, 61 nt, Human
cauaaaaugugagaaaaccaccuauaauuuaccacugugaacaauuauauaucuaucugcu

SEQ ID NO: 4509 - RNA, 61 nt, Human
cauaaaauuuuauaguacuaaaugucaagccuaacugugaauuuuguucuguaucuuaagu

SEQ ID NO: 4510 - RNA, 63 nt, Human
cauaaacaaucuuauguuguauaaaaauacguagagugacuuagacauguuugcaugaauaaa

SEQ ID NO: 4511 - RNA, 62 nt, Human
cauaauuaaacuauuucugcuauuauuuuuaaagcaguauuauuuuauaaccaauucuaaaa

SEQ ID NO: 4512 - RNA, 62 nt, Human
cauacaaaauacuuuuguauaugcauaauauaaaucaucucauguggauaugaaacuucuuu

SEQ ID NO: 4513 - RNA, 62 nt, Human
cauacacuucuuaaaaugugaaaaucuauguuuucaguauuaugacaguaucugcagauacu

SEQ ID NO: 4514 - RNA, 62 nt, Human
cauacuccuuccaucaaauagaaccacuaugaagcuaccucaaacuuccagucagguaguug

SEQ ID NO: 4515 - RNA, 63 nt, Human
cauacuugagugugcacaucuugagaaauaaacaagugacuuaacacacauugaaaaggacca

SEQ ID NO: 4516 - RNA, 62 nt, Human
cauagcauggcccuuaugucuugaguugagguuaucaucucaaugaggcuuaagcuccuaga

SEQ ID NO: 4517 - RNA, 61 nt, Human
cauagcauuacggacuuagcauaagaguaaaugacugugaacguuguaguaaacggcagcu

SEQ ID NO: 4518 - RNA, 61 nt, Human
cauagcuggguugcagcugcgaaccucauucugacugugaacuaagcaagcuuugaggagg

SEQ ID NO: 4519 - RNA, 63 nt, Human
cauagucaugauagugaguauucuuacacuguucccaguauuacagggaaugcuuagaaauuu

SEQ ID NO: 4520 - RNA, 63 nt, Human
cauauaaucacuccuguccuaauucuuggugauuucaguauuacaaagaugauccucccaaca

SEQ ID NO: 4521 - RNA, 64 nt, Human
cauauagagcuagcuaaucucuacaaacccucuguaggccaguaguucucaaaguguggucucu

SEQ ID NO: 4522 - RNA, 62 nt, Human
cauaucaucugaaaugguauggcugaaguucauuuguuuacagggucgggaaugucuucagu

SEQ ID NO: 4523 - RNA, 62 nt, Human
cauaucaugaaaaauucuacuuagcuauauuauuauaagcuacauuugcccugaauuugaac

SEQ ID NO: 4524 - RNA, 62 nt, Human
cauauccacugauuuccugauguccaugucuauauguuuacaagcaauauggagcaccauuc

SEQ ID NO: 4525 - RNA, 62 nt, Human
cauaugaagaccauaaaugugggaaagccuuugucaguauuaaucccuuaauugacauaagu

SEQ ID NO: 4526 - RNA, 62 nt, Human
cauaugaagucaauaaaugugggaaagccuuugucaguauuaaucccuuaauugaccuaagu

SEQ ID NO: 4527 - RNA, 62 nt, Human
cauauuguggaauugacucaaaaaugagguacuucaguauuaaauuagauaucuucauagca

SEQ ID NO: 4528 - RNA, 63 nt, Human
cauauuuacuugaguaaggaacacuuuugugcguacaguauuauuuggcuucuucaguugugc

SEQ ID NO: 4529 - RNA, 64 nt, Human
cauauuuguuaugccuuauucuaaaauugagucucaaacuggaaugccuuugaagacagaugcu

SEQ ID NO: 4530 - RNA, 63 nt, Human
caucaaaugaccaauggcuuuuaaggaaggacuaagugacuuaugaccagaacaagggagcag

SEQ ID NO: 4531 - RNA, 62 nt, Human
caucaauucauagcaguaacuuuaagagggcauugugcaauaguuaguuguuuucuuguuca

SEQ ID NO: 4532 - RNA, 61 nt, Human
caucacuagcugugugacaucgggcaaguucucacugugaacuggagauggcaauaggacc

SEQ ID NO: 4533 - RNA, 61 nt, Human
caucaggaaaaauacaccccaucgcccagcaccccugcugauaccaccagacagagagaga

SEQ ID NO: 4534 - RNA, 62 nt, Human
caucauaaaaggaaauauuuuuuuuuccuaggagcaguguuaaaaucugggucacauuccug

SEQ ID NO: 4535 - RNA, 62 nt, Human
caucaugaacacagcuaagggaaugauggucaaucaguguuaacuugcauauuguuggcaca

SEQ ID NO: 4536 - RNA, 64 nt, Human
caucauguaauagaaucgcuuuccagaaaggcaguuaacuggaagcagcagaggcucccagccg

SEQ ID NO: 4537 - RNA, 64 nt, Human
caucauguuggacacaguugagggugacaugcacagaacuggaacagaucacuauuaguggaaa

SEQ ID NO: 4538 - RNA, 63 nt, Human
caucauuuccauucaagucauccauucuugcauuugugacuuaaagguugacuggucaaaauu

SEQ ID NO: 4539 - RNA, 63 nt, Human
cauccagcggccacagcuagaaaacagucugcagugugacuuaacuuguguauugcauuccag

SEQ ID NO: 4540 - RNA, 57 nt, Human
cauccccuuccugcucugaggcgcucaccccugcugaggcucagccccucaacccgg

SEQ ID NO: 4541 - RNA, 62 nt, Human
cauccugucuucuucugugcugccugguuugaucucaucucaccuggauucaaaggguaagg

SEQ ID NO: 4542 - RNA, 61 nt, Human
cauccugucuuuuugcaaguaugaaucacuuaaccugcugauaguugaagaacacuuuagg

SEQ ID NO: 4543 - RNA, 62 nt, Human
caucgcaaaaaggcgauuugagaaaugugggcuucaguauuaauugccauuuugcugacacc

SEQ ID NO: 4544 - RNA, 61 nt, Human
caucgcuugagucauuuuuaucacaauaauccuacugugaagcugucguugagaacuuagg

SEQ ID NO: 4545 - RNA, 62 nt, Human
caucggacucuaucuguggccuuguucuucauuucaguguuaaucagcuaaacagaaguugu

SEQ ID NO: 4546 - RNA, 61 nt, Human
caucguccaccugccucggccuccccaaagugcugagauuaggcguuagccaccgcgcccg

SEQ ID NO: 4547 - RNA, 62 nt, Human
caucuaaugucaaaauagaaccaacugguaaucacaguauuauuuagugugguuuccaugac

SEQ ID NO: 4548 - RNA, 62 nt, Human
caucuacagauaugguuuuguggacaucuuuuucuguuuacauaaauuuauccacuuaaaau

SEQ ID NO: 4549 - RNA, 62 nt, Human
caucucaucaaguuuuuccccuucagaucugacagugcaauaggacagacguguggacuguu

SEQ ID NO: 4550 - RNA, 62 nt, Human
caucucuccacuguccuguaagcugugcagaaccugcugcuaacaccaaggugugaacaugc

SEQ ID NO: 4551 - RNA, 62 nt, Human
caucugaaggguauguugcaugcauuaaaaaaaaucaucucacaugcauuuuauaguuuugg

SEQ ID NO: 4552 - RNA, 62 nt, Human
caucuggucgugaagcaugugguaggcacacuugcaguguuacgaucggaaugcuuuuuauu

SEQ ID NO: 4553 - RNA, 62 nt, Human
caucuugaaaugaggauaauaauaccugcuguaccuaccucacagggcuguugugaggauua

SEQ ID NO: 4554 - RNA, 61 nt, Human
caucuuugggacaccucagaaaacuuauuaacaacugugaauaugagaaauacagaagaaa

SEQ ID NO: 4555 - RNA, 63 nt, Human
caucuuuguugagagauuugagguagcuccuguugcaguauuaauuuauaauauuuuaaaagu

SEQ ID NO: 4556 - RNA, 62 nt, Human
caucuuuucuuaagcacuauguuuguguuuuuaucaguauuauauucauugucuuuggaaua

SEQ ID NO: 4557 - RNA, 61 nt, Human
caucuuuucuuuccuauccuuucuuccccccucacugugaaaaauaacaguccaccccaag

SEQ ID NO: 4558 - RNA, 61 nt, Human
caugaaauaauccuagguguugggggggaaaguacugugaauaaugugugugaaggacuuu

SEQ ID NO: 4559 - RNA, 63 nt, Human
caugaagcaagaauggaggaauccuugacucuuacacacuggaaauugaaauaaagauaaaug

SEQ ID NO: 4560 - RNA, 62 nt, Human
caugaauucuggucacauuccauuucucuccaacaugaaggaucaaaaaauguuuuucaaug

SEQ ID NO: 4561 - RNA, 61 nt, Human
caugaccaacaucgcagacacaugugcuggccaccugcugagccccaaguggaacgagaca

SEQ ID NO: 4562 - RNA, 62 nt, Human
caugacucaggguuuugaguucuuaacugaucgaaugaaggauucaaaauuaaccacuccaa

SEQ ID NO: 4563 - RNA, 61 nt, Human
caugagaagaugccugcucugacuuugccuuccacugugaauaaaagcuuccugaggccuc

SEQ ID NO: 4564 - RNA, 62 nt, Human
caugagcuuuucuggcauauguuaugcauguuggcaguauuaaguguauaccaaauaauaca

SEQ ID NO: 4565 - RNA, 62 nt, Human
caugauaugguauccuuuugagugagguauauacucaucucacaagugaagugccuacugau

SEQ ID NO: 4566 - RNA, 62 nt, Human
caugauucagggaaugaagaaucacaggcuugggcaguguuaaacacuguggccuauggucc

SEQ ID NO: 4567 - RNA, 62 nt, Human
caugauuuauuugaagauggagcacugcugauuuaugaaggaaaaaagaagaauuuucuaaa

SEQ ID NO: 4568 - RNA, 62 nt, Human
caugauuuuaauccagaacuuccucauaaaaugcaugaaggacuuugaucgugaauuuuuuu

SEQ ID NO: 4569 - RNA, 62 nt, Human
caugcacaaguuauaaugcuguuggcagagaguucaguguuacugaaucaacaauauguugc

SEQ ID NO: 4570 - RNA, 63 nt, Human
caugcauguuucuuccuguacauuuauuugagaaaacacuggauuuaaauaauuuuaaauaau

SEQ ID NO: 4571 - RNA, 62 nt, Human
cauggaaaaacuuuaggaaaugcacuuauuaggcuguuuacauggguugccuggauacaaau

SEQ ID NO: 4572 - RNA, 62 nt, Human
cauggaaauuuagggguuucugaaucaagcuuaauguuuacaguuuccaaauagccauuuug

SEQ ID NO: 4573 - RNA, 63 nt, Human
cauggaagucauaaauggacauuauagucucuaaacaguauuaaacccuuaaccacuucuaaa

SEQ ID NO: 4574 - RNA, 64 nt, Human
cauggacagaggcaggaaguaaggaaacugauguuaaacuggaaccuaagacagugaugaagau

SEQ ID NO: 4575 - RNA, 62 nt, Human
cauggauguugggucucugugcggacggugacaauguuuacaagcaccacauuuacacaucc

SEQ ID NO: 4576 - RNA, 62 nt, Human
cauggcagaaguggagaaucagaauggccugccuugcugcuaaagagcuggaugguguggaa

SEQ ID NO: 4577 - RNA, 62 nt, Human
cauggcauugcugcuuuuagcaaaaaacaacuaccaguguuacucauaugauuaugaaaauc

SEQ ID NO: 4578 - RNA, 62 nt, Human
cauggccacgcuguggaaugaugugaauuggcccuguuuacagaggcaguacaacugaaugu

SEQ ID NO: 4579 - RNA, 63 nt, Human
caugggguuuauguuuuauuucagauuuuauuugugugacuuagaaauuccaggaacacaauu

SEQ ID NO: 4580 - RNA, 64 nt, Human
cauguacuaaggaaugagauuauaugcaguaaacccaacuggaagauuaacaauauuaaaauau

SEQ ID NO: 4581 - RNA, 63 nt, Human
cauguauauacauuuuuaaaagugcuuucuuugaaacacuggaacuuuguuaagcugccuuuu

SEQ ID NO: 4582 - RNA, 64 nt, Human
cauguauuauuuuucaguuucagcuagcgaugcagaaacuggaaaauguaaaacuuagaucaug

SEQ ID NO: 4583 - RNA, 62 nt, Human
caugucacuagguaacacagauccauccagaugguguuuacauuugauuuauuugggaucuu

SEQ ID NO: 4584 - RNA, 64 nt, Human
cauguccccaacgcagguccagccaucucugcacagaacuggaaucucgguucauuucgguuuc

SEQ ID NO: 4585 - RNA, 63 nt, Human
cauguccccuggcccugccuuggcagagguccccagugacuuaugcuaggaggauuccaucug

SEQ ID NO: 4586 - RNA, 63 nt, Human
caugucucugcuagcaguucugacguguccauuccacacuggauccauagaacgagggaacac

SEQ ID NO: 4587 - RNA, 64 nt, Human
cauguggcagcuuugcauagggagaggauagcuccgaacuggaacugaacugccuucucugcac

SEQ ID NO: 4588 - RNA, 60 nt, Human
caugugggugcccuccugaggaaucuugaggcacugugaaauuuaaguguaagacauuga

SEQ ID NO: 4589 - RNA, 62 nt, Human
cauguguacauuuuuaaucuguuauaguuggcggcaguauuaaaauggugaguaaagagccc

SEQ ID NO: 4590 - RNA, 64 nt, Human
cauguguucacaaaaauugccuccccggcagagauuaugcaguaagauaauuuaacugaauaau

SEQ ID NO: 4591 - RNA, 62 nt, Human
cauguguuuaguguaaacucucugcauggauucucaguguuaauaauaaaaggaagcauucu

SEQ ID NO: 4592 - RNA, 62 nt, Human
cauguuaagaccauaauguaguuauaaauggaaauguuuacaccugaagugaguauuuucaa

SEQ ID NO: 4593 - RNA, 63 nt, Human
cauguuagaucguugaaacccuguaucccucugaaacacuggaagagcuaguaaauuguaaau

SEQ ID NO: 4594 - RNA, 62 nt, Human
cauguugcaauagcaaaacccccaguuagauuaguguuuacacauuuucucaguuauuuaau

SEQ ID NO: 4595 - RNA, 62 nt, Human
cauguuuguacuuugucuucccauuaaccuuugccaguguuaugauuguauaaauuuuuuua

SEQ ID NO: 4596 - RNA, 62 nt, Human
cauuaaaucuuuaaaagaaaugaaauaaauuuauuguuuacaguuaauauuacugaaucauu

SEQ ID NO: 4597 - RNA, 63 nt, Human
cauuagagauccagcacauucucaguacuguggugcaguauuagcccaaaucuguguaauggg

SEQ ID NO: 4598 - RNA, 62 nt, Human
cauuagaugaauagagaauauuaauuuugcagaaaugaaggaaaaucucuucgugcuaguac

SEQ ID NO: 4599 - RNA, 62 nt, Human
cauuagcugaggauuauuucuauccaauuuccugaugaaggacauugccuuuugagauuaaa

SEQ ID NO: 4600 - RNA, 63 nt, Human
cauuaggaagccauaaaacaagauauuaugaaacccaguauuauaaauguuaucuacaucuaa

SEQ ID NO: 4601 - RNA, 62 nt, Human
cauuaggagcucuuucucucacucuucugucauuugcugcuauguugaaauucuuauuuuga

SEQ ID NO: 4602 - RNA, 63 nt, Human
cauuauauauagaguuucuuuuuccacgguagucagugacuuaaccugaauuguaaauguuug

SEQ ID NO: 4603 - RNA, 63 nt, Human
cauuaugacuaaucugcuuuaggaguugggguaaccaguauuacaggagggacuuucagagcc

SEQ ID NO: 4604 - RNA, 62 nt, Human
cauucacacagauauuuugggauaauaaaggaaaauaagcuacaagacaggccugauguggu

SEQ ID NO: 4605 - RNA, 62 nt, Human
cauucagugaagcguuauuaugccacaaacuaaccuaccucaccuuacucaaugguguaggu

SEQ ID NO: 4606 - RNA, 62 nt, Human
cauucaguguaguuggauuuugggaccuuggccucaguguuauuuacugggauuggcauacg

SEQ ID NO: 4607 - RNA, 63 nt, Human
cauucauuuauuucuguuuuguuuaccgacauauucaguauuauucuuguuuucugaauucug

SEQ ID NO: 4608 - RNA, 62 nt, Human
cauucuaagaccagauucucuaauguuucugggugugcaauagagugaucacaucuuuguuu

SEQ ID NO: 4609 - RNA, 61 nt, Human
cauucuauuaauuauauuuuuucuagauugaauacugugaaugcuaaguuuuauuaaucug

SEQ ID NO: 4610 - RNA, 62 nt, Human
cauucuguguauauagaauguaaaaggaauauuacaguguuaacugccauauauguaauaua

SEQ ID NO: 4611 - RNA, 62 nt, Human
cauucuugaacuuagaguauguaaauguaauaaauuccguuauccaggaguauaagcaaaua

SEQ ID NO: 4612 - RNA, 64 nt, Human
cauugauguacagucaauuauugaugcuguuuaucaaacuggaauucacucugcugaauuuccc

SEQ ID NO: 4613 - RNA, 63 nt, Human
cauugcaacauuuccaucagacagcauuucaauuccaguauuauguauauugcaaauuaaaca

SEQ ID NO: 4614 - RNA, 62 nt, Human
cauugcacuccagccugggugacagagugagacuucaucucaaaauaaauaaauaaaaauca

SEQ ID NO: 4615 - RNA, 64 nt, Human
cauugcagaauauugcauggagcacagugcuuccaaaacuggaaggaauuggccuggauuagga

SEQ ID NO: 4616 - RNA, 61 nt, Human
cauugcuccaugucaggcuguuccccauugugcccugcugaugcuuuggguccagggccuc

SEQ ID NO: 4617 - RNA, 62 nt, Human
cauugcugggauguuucugcccacgguuuuguuugugcaauaacguuaucacauuucuaaug

SEQ ID NO: 4618 - RNA, 62 nt, Human
cauugcuugaaaaucucucuugacagggagcucacuaccucacaaggcaggucauuucauug

SEQ ID NO: 4619 - RNA, 62 nt, Human
cauuggacccugacuguauacagaaugaaaggcagugcaauauuuagcugcuaacaagacug

SEQ ID NO: 4620 - RNA, 62 nt, Human
cauugggaacauauuucuuaacaagcuaacuguguguuuacauagagagagcugcauauugc

SEQ ID NO: 4621 - RNA, 61 nt, Human
cauuguauguaauguccaucaguauaaauugagacugugaauuucuaggacccacaaaagu

SEQ ID NO: 4622 - RNA, 62 nt, Human
cauuguccaccuuacuaaaagucaguagaaucuucuaccucauaacuuccuuccaaaggcag

SEQ ID NO: 4623 - RNA, 62 nt, Human
cauuguccuugagacccuacaugugcaguuuggcucaucucauuaaagaugcuugauguaau

SEQ ID NO: 4624 - RNA, 61 nt, Human
cauuguugagguuaaguuucucuucaccccuacacugugaaggguacagauuagguuuguc

SEQ ID NO: 4625 - RNA, 62 nt, Human
cauuuaauaagaaacauuuggauucuuuugaaaucaguguuaauugacucauauucuuaaaa

SEQ ID NO: 4626 - RNA, 62 nt, Human
cauuuauaaagugggaaacucauaauuguccuaccuaccucacagggguguugugaggauca

SEQ ID NO: 4627 - RNA, 62 nt, Human
cauuuaugacccaaucuguacuaauucuccaaaccaguauuauuucaauuauggcacuuggg

SEQ ID NO: 4628 - RNA, 64 nt, Human
cauuuccauuucuauggguuuuccuuucuuuccuuuaugcaguagaugcuuucuuccuccugca

SEQ ID NO: 4629 - RNA, 64 nt, Human
cauuugaaaguguauuugccagacaaugaaaacaguaugcaguauuucuuaaaguauugaaauu

SEQ ID NO: 4630 - RNA, 63 nt, Human
cauuugcuagacgguuggugaguggcaucaaaugugugacuuacuaucuugggccagaacuaa

SEQ ID NO: 4631 - RNA, 62 nt, Human
cauuugcuuuaagaaaacagucuugaauuucacaugcugcuauuuuuauauuuugccauuuu

SEQ ID NO: 4632 - RNA, 62 nt, Human
cauuuggacaguuaacauccagguguuacaaagucaguguuaauucuaaagaugaucauuuc

SEQ ID NO: 4633 - RNA, 62 nt, Human
cauuugucucuaauacucaaauucaacauauggcucaucucaucuaccuucccauuuccaug

SEQ ID NO: 4634 - RNA, 62 nt, Human
cauuuguuacccaugguguucuuuguuccuuuucauaagcuaauaccacuguagggauuuug

SEQ ID NO: 4635 - RNA, 64 nt, Human
cauuuuaaauuauuuccaaagauagugacaggagagaacuggaacaaauuuaccaacuuugugg

SEQ ID NO: 4636 - RNA, 63 nt, Human
cauuuucagguaucuuuauagcaaugccccacucccaguauuaauuuucuguauuaguccauu

SEQ ID NO: 4637 - RNA, 62 nt, Human
cauuuuccauuuuuguuuaaucaaauacuugcuuaugaaggauuucagaaauuuguaauaaa

SEQ ID NO: 4638 - RNA, 63 nt, Human
cauuuuccuuaagcugcuugggcuacaugugaaauacacuggacggucaacauuccugucucc

SEQ ID NO: 4639 - RNA, 63 nt, Human
cauuuucucccguauuuguuaccuuccugaggccucaguauuagucgugagcacaaaguuuug

SEQ ID NO: 4640 - RNA, 63 nt, Human
cauuuucucucguuacucagaagcaaauuuguguuacacuggaagugaccuaugcacuguuuu

SEQ ID NO: 4641 - RNA, 61 nt, Human
cauuuugagacugucaugaguuagaccagugguugagauuaguagauggcucacuagacau

SEQ ID NO: 4642 - RNA, 64 nt, Human
cauuuugcugugacacccugaaaaagcugaccacaaaugcaguauuaucuugacauaccucugu

SEQ ID NO: 4643 - RNA, 62 nt, Human
cauuuuguauaauggccagaacuuugucgugugacaguauuagcacugccucaguuaaaggu

SEQ ID NO: 4644 - RNA, 61 nt, Human
cauuuuucuggaguggaaaagcuuaaaaaaauuacugugaauuguuuuuguacaguuauca

SEQ ID NO: 4645 - RNA, 63 nt, Human
ccaaaaggaaugaaagagagcucuaaccagauggaacacuggaacauuccaguggacccugga

SEQ ID NO: 4646 - RNA, 63 nt, Human
ccaaaauaauguauuaugguugggaagucaguagaacacuggaauaggugaagaccugacagu

SEQ ID NO: 4647 - RNA, 62 nt, Human
ccaaagaagaugauuuaaugguagaacggauaccugcugcuagaccugauggaauguuaccu

SEQ ID NO: 4648 - RNA, 62 nt, Human
ccaaagagugcaggccagguuccuuauccuucugaugaaggaugagagagcucauuuagaag

SEQ ID NO: 4649 - RNA, 63 nt, Human
ccaaaggacauucuaaauguuuucuuguugcuuuaacacuggaagauuuaaagaauaaaaacu

SEQ ID NO: 4650 - RNA, 63 nt, Human
ccaaaggccuaacccuauucaacaccagaaaguuuacacuggagaaaggccuuagggugacag

SEQ ID NO: 4651 - RNA, 62 nt, Human
ccaaauuguccggugucaugagcugacagcagggaugaaggaggggucuguucucggugccc

SEQ ID NO: 4652 - RNA, 62 nt, Human
ccaacacaaaacuguguuuacugaaagccgaaaacaguauuaaaaaaaguguguaaguaaag

SEQ ID NO: 4653 - RNA, 62 nt, Human
ccaacaccagccccugccccagcccaaguccaaauguuuacagggagccuccugcccagucc

SEQ ID NO: 4654 - RNA, 61 nt, Human
ccaacacuguugagggaaagcuguuccucaggaccugcugaguggccauauucccugaagg

SEQ ID NO: 4655 - RNA, 64 nt, Human
ccaacagcacaacuuugaaaacuguuaaguauuuugaacuggaaauaguaacacgugccuucuu

SEQ ID NO: 4656 - RNA, 61 nt, Human
ccaacucaagcuacagcagcagcacuucccaagccugcugaccacagucacaucacccauc

SEQ ID NO: 4657 - RNA, 63 nt, Human
ccaagaacugcauggaccuaacauucgaucucauucaguauuaaaggggggagggggaggggg

SEQ ID NO: 4658 - RNA, 61 nt, Human
ccaagaagaaucccaccucagugaaaugcuacaacugugaauugacguaaccuagaauguc

SEQ ID NO: 4659 - RNA, 63 nt, Human
ccaagacacaacuauuaagacgaugaaggcaucgacaguauuaaugucaggugaucugaaaua

SEQ ID NO: 4660 - RNA, 62 nt, Human
ccaagcugucuucaagaaugaccacgacugucuucaguguuaaaauccaucaccuaaagggc

SEQ ID NO: 4661 - RNA, 62 nt, Human
ccaagcuguguugacugucauccccaccccaccccuaccucacgccugccccacccccugcc

SEQ ID NO: 4662 - RNA, 61 nt, Human
ccaagugacauucucagugauaauggagguuucacugugaagcaucaccagcagauccuug

SEQ ID NO: 4663 - RNA, 62 nt, Human
ccaagugaguggagaguguuuuuaauguuuuugaaugaaggaaaugagguuuuguuucaccu

SEQ ID NO: 4664 - RNA, 62 nt, Human
ccaaguguuugcuaugugcaacacaccgcgugagcaguguuaccugcauuauuacauuaggc

SEQ ID NO: 4665 - RNA, 62 nt, Human
ccaauagcaaauugcacuacagcugaacuuuucaucaucucauucacauuugggaaacgaac

SEQ ID NO: 4666 - RNA, 56 nt, Human
ccaauauggcaucaucuagccacgaggcccugcugaaguccagacccucccccucc

SEQ ID NO: 4667 - RNA, 62 nt, Human
ccaauauuaaaucugcuggaguuucauguacaagaugaaggagaggcaacauccaaaauagu

SEQ ID NO: 4668 - RNA, 62 nt, Human
ccaaucacaguguuauguaguauuguucuauuuuuguuuacaaacauggaaaacagaguauu

SEQ ID NO: 4669 - RNA, 63 nt, Human
ccaauccaagauuagacuacacaaaagcuuccuuccaguauuaaacaaaaagaauuaaacaua

SEQ ID NO: 4670 - RNA, 61 nt, Human
ccaauggggcugccucuuuuccuuucaucagacacugugaaaacauucccuuaagcgugca

SEQ ID NO: 4671 - RNA, 62 nt, Human
ccaaugugcuguaaaguguuuuauuguaaauugcucaucucaauaaaauuuacuucagguuu

SEQ ID NO: 4672 - RNA, 62 nt, Human
ccaaugugguucaggauucuugauccuagccgugcaguguuaauccagugcagcaauggaac

SEQ ID NO: 4673 - RNA, 61 nt, Human
ccacacauucagaggugguuugugaagucuuccacugugaacuaugguuuuuuuuuuuuuu

SEQ ID NO: 4674 - RNA, 62 nt, Human
ccacaccaugggcagaacugcugucuuuacuacuucaucucacccaagucccguucccaggc

SEQ ID NO: 4675 - RNA, 62 nt, Human
ccacacgagcacgugccacgcaugccucgugugcucaucucacacacaccccccucccgggu

SEQ ID NO: 4676 - RNA, 62 nt, Human
ccacagagccugggcugggcccgguggaggcuccuguuuacagcccucucuucuuuguacag

SEQ ID NO: 4677 - RNA, 62 nt, Human
ccacagauccacagcaggggaccauaugucgaacuguuuacauggauguugcucuaagugaa

SEQ ID NO: 4678 - RNA, 62 nt, Human
ccacaggaugcuccuggagccucuucucuggcugcuaccucagggcaugguuguggccccac

SEQ ID NO: 4679 - RNA, 63 nt, Human
ccacauaaguuuuauagguacaacugucaaagacgacacuggagaagagccaagcuggaucua

SEQ ID NO: 4680 - RNA, 62 nt, Human
ccacauuauccaacugugcaucucaaacauauccucaucucaguaaagacaaaaguuucuau

SEQ ID NO: 4681 - RNA, 62 nt, Human
ccacauuuuuaucuagaugaaaauuuggaaugaaaugaaggaauagaaauccaauaaaagag

SEQ ID NO: 4682 - RNA, 62 nt, Human
ccaccacacccagcccggacagcuucuuugggagugcugcuaaccuugaaauuaucagacac

SEQ ID NO: 4683 - RNA, 64 nt, Human
ccaccauaaggccaaauaagggagcgagguugugaaaacuggaaaacaaaggcucuuuucagag

SEQ ID NO: 4684 - RNA, 62 nt, Human
ccaccaugccuggccuuuggggggauuuuaauuacaguauuaauuauaguucuaggauuucc

SEQ ID NO: 4685 - RNA, 61 nt, Human
ccaccauugccuguuagccagucaguuuuagucacugugaaauauuucacauucagccucc

SEQ ID NO: 4686 - RNA, 64 nt, Human
ccaccccaugcccaguggucucaguagauacuucuuaacuggaaauucuuucuuuucagaaucu

SEQ ID NO: 4687 - RNA, 62 nt, Human
ccaccccuaaggaccaagggagccugagcggccuuguuuacagcuucuguccugcuccugca

SEQ ID NO: 4688 - RNA, 63 nt, Human
ccacccucaccccggccccccacccgcagccggccacacuggagcagcucccagcacagccuu

SEQ ID NO: 4689 - RNA, 63 nt, Human
ccacccugaccucccccagggcuccuccccagccggugacuuacuguacagcaggcaggaggg

SEQ ID NO: 4690 - RNA, 62 nt, Human
ccacccuuuucuaugcagaagucugucuuccuccugcugcuaucauauuguccauagugccc

SEQ ID NO: 4691 - RNA, 64 nt, Human
ccaccgauuccaagaggaugaggaguguuuucuaaaaugcaguaggcuuggggagucggagagu

SEQ ID NO: 4692 - RNA, 61 nt, Human
ccaccugcaagauggacacgagccacaagcugcacugugaaccugggcacuccgcgccgau

SEQ ID NO: 4693 - RNA, 62 nt, Human
ccaccugcaccuucucccccucucacagugucacugcugcuaauggucaaagucaaaugugu

SEQ ID NO: 4694 - RNA, 61 nt, Human
ccacgaaguuuauguuuggauuacaugcacgugugagauuauuugcaauaauucauagguu

SEQ ID NO: 4695 - RNA, 61 nt, Human
ccacgcccagccuguuuuuauaaacugaagccaacugugaauaaacuguagccuacauuac

SEQ ID NO: 4696 - RNA, 62 nt, Human
ccacgucuagcagacuuuacaauaaaaugucaauaugaaggacuguaauuccuagcaguuua

SEQ ID NO: 4697 - RNA, 62 nt, Human
ccacgugguagccacuggcagccuugacugaaagaugaaggaguccauggugcuaggaggag

SEQ ID NO: 4698 - RNA, 62 nt, Human
ccacguguccuggucacuggucuuuauaauuguugugcaauaacuaaaggcuaaggacuaga

SEQ ID NO: 4699 - RNA, 62 nt, Human
ccacguguuaaaggaaucuauacucgcaauaggaauaagcuaaugcccauuuucagaaauaa

SEQ ID NO: 4700 - RNA, 64 nt, Human
ccacuacuuaaguacuugucauguacucuuagaggaggccaguaaugaucagaaccauuuuacu

SEQ ID NO: 4701 - RNA, 62 nt, Human
ccacucuauaaaaucauggcaauaauagaagauuaugaaggauuucuauggaggacauaaau

SEQ ID NO: 4702 - RNA, 62 nt, Human
ccacucucagccacugggugugucacucuccucuucaucucagcauucuccaucacuucccc

SEQ ID NO: 4703 - RNA, 61 nt, Human
ccacucugccacccugccauuggaacuuggauuacugugaacauugcagcuauagcaaaau

SEQ ID NO: 4704 - RNA, 62 nt, Human
ccacucugcccugaccccgaucaguuaaggagcugugcaauaaccuuccuaguaccugagug

SEQ ID NO: 4705 - RNA, 62 nt, Human
ccacugaagauaccccaaaggaugcaagugccuacaguauuaucaggaggagaacaugaaaa

SEQ ID NO: 4706 - RNA, 62 nt, Human
ccacugcacuccaccugggcgacagagugagacuucaucucaaaaaccagcgcaagggugcu

SEQ ID NO: 4707 - RNA, 61 nt, Human
ccacugcgagggggacaguggcggugggacugaccugcugacagucacccucccucugcug

SEQ ID NO: 4708 - RNA, 62 nt, Human
ccacugugcgggccaguguguguuuacacaaauuucaucucagcuuugaaaaugcugcuauu

SEQ ID NO: 4709 - RNA, 63 nt, Human
ccacuuucuugggacuuggagggagguggaacagcacacuggacuucucccgucucuagggcu

SEQ ID NO: 4710 - RNA, 62 nt, Human
ccacuuugcacacccgcucuccggcccgcgccccuguuuacagcgucccuguguauguugga

SEQ ID NO: 4711 - RNA, 61 nt, Human
ccacuuuuccuaggcacccuugcacauuuuguuacugugaaggacuauugcccuguuaccu

SEQ ID NO: 4712 - RNA, 62 nt, Human
ccagaaagacgcacuccuggaccacaaccggcggcuaccucagccccacggcucugcaggau

SEQ ID NO: 4713 - RNA, 62 nt, Human
ccagaaccuggaacagggacuuucacuugaaucuugcugcuaaauguaaaugccuucucaaa

SEQ ID NO: 4714 - RNA, 64 nt, Human
ccagaacuuggguugagggcacuaccagacugacauggccaguacagaggagaacuagggaagg

SEQ ID NO: 4715 - RNA, 62 nt, Human
ccagaagggaggagugggcuuugaacuuagacaucuaccucagagcucaaauagguuguuua

SEQ ID NO: 4716 - RNA, 61 nt, Human
ccagaagggucauucggggcgggagacccugagccugcugagaaauccuuuuagcgccagc

SEQ ID NO: 4717 - RNA, 61 nt, Human
ccagagcccagcucuugcucucuugugacgugcacugugaauccuggcaagaaagcuugag

SEQ ID NO: 4718 - RNA, 62 nt, Human
ccagagccucuuccuguguccugugugucugguauguuuacaccuugcucugaguuuuucuc

SEQ ID NO: 4719 - RNA, 62 nt, Human
ccagaggugugacaggcucuagucuccucccuguuguuuacagcauauuuaagucuugugaa

SEQ ID NO: 4720 - RNA, 63 nt, Human
ccagauuauuugaaucacacaggaugauguguuaacaguauuaggguggaagaggaaucaaga

SEQ ID NO: 4721 - RNA, 62 nt, Human
ccagcaaccuggaguccaauuuucaguauuuuaacuaccucaauaaugcuaugaauguaaga

SEQ ID NO: 4722 - RNA, 64 nt, Human
ccagcacuccagacucgagggaagccagcuuccaagaacuggaaugcguacgucuuuugugcca

SEQ ID NO: 4723 - RNA, 61 nt, Human
ccagcagagaugcucagaagaugaaugaaagucccugcugagauugauccaaucuguuugu

SEQ ID NO: 4724 - RNA, 62 nt, Human
ccagcagugccugcccguguccccaugucccggcaugaaggacacugcuagagaguuaccau

SEQ ID NO: 4725 - RNA, 62 nt, Human
ccagccaccuccagacaccagugcgugcucccgaugcugcuauggaaggugcuacuugaccu

SEQ ID NO: 4726 - RNA, 63 nt, Human
ccagccacugcccucucuuaggccccucauuuaaaaacgguuauacuauaaaaucugcuuuuc

SEQ ID NO: 4727 - RNA, 64 nt, Human
ccagcccagcccugaccucaggaagugucagagcauggccaguaguuggcagcccgaaagacac

SEQ ID NO: 4728 - RNA, 64 nt, Human
ccagcguccuaggaaccagcuucuacuuugacauaaaacuggaaaucauuuucacuccaguuua

SEQ ID NO: 4729 - RNA, 64 nt, Human
ccagcuaaaaaccguuguuugcuuuaaauuuucauaaacuggaauccuuucacccgcuccuaca

SEQ ID NO: 4730 - RNA, 61 nt, Human
ccagcucccccagccccacgaaacugggccuuuccugcugagaggaagugacuuuuuacag

SEQ ID NO: 4731 - RNA, 62 nt, Human
ccagcucugaaauuaauuaggaaagaauauaggauguuuacagugaauaauuuuaaaaccac

SEQ ID NO: 4732 - RNA, 62 nt, Human
ccagcugcuccagacccccgcuccugggauucgccuaccucaagccuccauucuccauccgc

SEQ ID NO: 4733 - RNA, 63 nt, Human
ccagcuguauguuuuuccacugugcguguacacacacacuggaaaauaauuaggcugauuuug

SEQ ID NO: 4734 - RNA, 62 nt, Human
ccaggaacucugcagaguccaugcugugagcuuccuaccucagcccaucugcaggcagagaa

SEQ ID NO: 4735 - RNA, 63 nt, Human
ccaggacguggccucuuccgauccuuuucucucagacacuggaggucucuucugccauugugc

SEQ ID NO: 4736 - RNA, 63 nt, Human
ccaggagacacggucccaggcacugcacaggccugcaguauuaccaggcggaggggcugcuuu

SEQ ID NO: 4737 - RNA, 62 nt, Human
ccaggcagcuugacuugagaggacgacccuagggcuaccucaguuucccccaucuccucugc

SEQ ID NO: 4738 - RNA, 62 nt, Human
ccaggccauuuaaagccuggaguaccagcgcauaucaucucaugggguccagaguggagucc

SEQ ID NO: 4739 - RNA, 61 nt, Human
ccagggcagauacugacaagugacugaacuuugacugugaagucuucccauuuauuuuuga

SEQ ID NO: 4740 - RNA, 62 nt, Human
ccaggguccuucccugccccacuuccccuuuucccaguauuacugaauagucccagcuggag

SEQ ID NO: 4741 - RNA, 64 nt, Human
ccagggucucgcucccugcccuuggggcccggggccaugcaguaccuggaguguccugcagggg

SEQ ID NO: 4742 - RNA, 63 nt, Human
ccaggguuuggggagccagccucccccgccccccuacacuggaauuuguuuguguuucuucac

SEQ ID NO: 4743 - RNA, 61 nt, Human
ccaggugccuggccuggccuagaccucuggaauugagauuaaacaauuuggaguuggauug

SEQ ID NO: 4744 - RNA, 61 nt, Human
ccaggugugguggcucaugccuguaauccagcaugagauuacaugcugagauuacagcugu

SEQ ID NO: 4745 - RNA, 62 nt, Human
ccagucaacuguggcaccuguaaccucccggaacaugaaggacuaugcucugaggcuauacu

SEQ ID NO: 4746 - RNA, 61 nt, Human
ccagucagcugacuuccucgugcaauguguuaaacugugaacucugcccaugugucaggag

SEQ ID NO: 4747 - RNA, 64 nt, Human
ccagucccaaggguccacgauguacaaagucauuucggccaguaggugugcagaccccuccccg

SEQ ID NO: 4748 - RNA, 62 nt, Human
ccaguccccaguucaccagcuuuguauccagucgucaucucauucaaguauggcuuuacuug

SEQ ID NO: 4749 - RNA, 63 nt, Human
ccagucuagccaaaagcucaagugggacaauggcacaguauuaaggucaaggacaaaaacuua

SEQ ID NO: 4750 - RNA, 61 nt, Human
ccagugaaggccaagcacugucaggcuggugccccugcugauguggccugcucugugcgcc

SEQ ID NO: 4751 - RNA, 62 nt, Human
ccagugcugggugcagcuccaucacccucuuguguguuuacaugucucuuucuaugauaaga

SEQ ID NO: 4752 - RNA, 61 nt, Human
ccaguggaauaggauagcugauugguguuuguuacugugaacccuagaccguaccccguag

SEQ ID NO: 4753 - RNA, 64 nt, Human
ccagugguuuggcuggauggucagggaguucaauauaacuggaaaauuggugacaaagaaauuu

SEQ ID NO: 4754 - RNA, 62 nt, Human
ccaguguguucaccucaucaaggcagcagaguggaugaaggaguaagucugcccuuugccau

SEQ ID NO: 4755 - RNA, 62 nt, Human
ccaguugacuuuuauucauuagauacagaaggugcaguauuacacaucaccagcugccuuug

SEQ ID NO: 4756 - RNA, 61 nt, Human
ccaguugaggauauucuccaaguuguccucucuccugcugauggaaaugggaaugaaguua

SEQ ID NO: 4757 - RNA, 61 nt, Human
ccaguuuaccuaaauguucacugacacaaaggaugagauuacaccuacagugacucugagu

SEQ ID NO: 4758 - RNA, 64 nt, Human
ccaguuuaggagcucaguugagaaacaguuccauucaacuggaacauuuuuuuuuuuuccuuuu

SEQ ID NO: 4759 - RNA, 62 nt, Human
ccauaaggaagagauucuuuaccaggcugugagccaguguuagauaacuugugaauggauau

SEQ ID NO: 4760 - RNA, 62 nt, Human
ccauaauuuucagaugaagauguuucccaaacacuguuuacagaaugagaugugacucuaca

SEQ ID NO: 4761 - RNA, 62 nt, Human
ccauacucagauaucagucugcuagaacuuuaaaaugaaggacaaauccuguuaaagaaaua

SEQ ID NO: 4762 - RNA, 61 nt, Human
ccauagcacuguuggccucaggagugcacagcuccugcugauguauuuuucuuuuugugaa

SEQ ID NO: 4763 - RNA, 64 nt, Human
ccauagccacaccacaggauuuccugaaaguuuacaaugcaguagcauuuugggguguagggug

SEQ ID NO: 4764 - RNA, 61 nt, Human
ccauagcccugccacccacuguaaaaagguugaugagauuacuuaaugauuuccaauuaag

SEQ ID NO: 4765 - RNA, 64 nt, Human
ccauaugguuguuccauuuucauaaaauuggaaacaaugcaguaauagcuuauuguuuuguuuu

SEQ ID NO: 4766 - RNA, 62 nt, Human
ccaucaccacacuccccccagccuucaccuggccaugaaggaccuuuugaccaacucccugu

SEQ ID NO: 4767 - RNA, 62 nt, Human
ccaucagaaaagcauauucuuuuugauagagggucaguguuauaaauaauugucuuuugaaa

SEQ ID NO: 4768 - RNA, 64 nt, Human
ccaucccuuuuuucuuuguuguuuuuguugaaaacaaacuggaaacuuguuucuuuuuuuguau

SEQ ID NO: 4769 - RNA, 62 nt, Human
ccauccuuucuccuuucugccagccgauguguccucaucucaggcccgugccugggaccccg

SEQ ID NO: 4770 - RNA, 62 nt, Human
ccaucuaaaugagacaacaaagcacaauguucacuguuuacaaccaagacaacugcgugggu

SEQ ID NO: 4771 - RNA, 64 nt, Human
ccaucucugaaacaaucugcuuacauccuccucagcaacuggaauuccucaaguuaguuagaca

SEQ ID NO: 4772 - RNA, 62 nt, Human
ccaucugggaaugauuaacacaaauguuggagcauguuuacauacaaacaaaguaggauuua

SEQ ID NO: 4773 - RNA, 62 nt, Human
ccaucuguaaaaugggagaauaauacuugccuaccuaccucacagggguguugugaggauuc

SEQ ID NO: 4774 - RNA, 62 nt, Human
ccaucuuucacucaggaugaaugcgaaaagugacuguuuacagaccucagugaugucagcac

SEQ ID NO: 4775 - RNA, 63 nt, Human
ccaucuuuucuuaagcacuauguuuguguuuuuaucaguauuauauucauugucuuuggaaua

SEQ ID NO: 4776 - RNA, 61 nt, Human
ccaugacagaaaguaaauuuuaggaaauaguuaugagauuaagggaaaaucuauaaaaaca

SEQ ID NO: 4777 - RNA, 64 nt, Human
ccaugauggcagacauucuaccccuuuuccuggaaaaacuggaagaaugaaaauaauuuuuuuc

SEQ ID NO: 4778 - RNA, 64 nt, Human
ccaugcuacaguuagucuugucccaauuaaaauacuaugcaguaucucuuacaucaguagcauu

SEQ ID NO: 4779 - RNA, 61 nt, Human
ccaugcuagccauggucaucugacagucucuacacugugaauauugccuggugaucaagac

SEQ ID NO: 4780 - RNA, 63 nt, Human
ccaugcugguggugauuuuuuagccccuaaauaaaacacuggacuauuuccuguuuacuucau

SEQ ID NO: 4781 - RNA, 62 nt, Human
ccauggaucagcucuuccuguguuuguaauuuaaugcugcuacaagauguuucuguuucuua

SEQ ID NO: 4782 - RNA, 62 nt, Human
ccaugguaccaaucaugaaucuuuguuucagguucaguauuauguaguuguucguugguuau

SEQ ID NO: 4783 - RNA, 64 nt, Human
ccauggugugucuggguaacugugagcaguuuauguaacuggaaugaaaagggcucagaggaau

SEQ ID NO: 4784 - RNA, 62 nt, Human
ccaugugcaaacugauccauccuguuuuuccuuuuguuuacaacacaguaguguucuguuca

SEQ ID NO: 4785 - RNA, 62 nt, Human
ccaugugccaugcacugugguauauguaugcauaucaucucaaccaauccuuaaaucaaccu

SEQ ID NO: 4786 - RNA, 62 nt, Human
ccaugugccuacaaaugucaguugugauuuccacuguuuacaagugaguggagcuggagcug

SEQ ID NO: 4787 - RNA, 62 nt, Human
ccauguuagcucaugguguaagaugaugucuugucaguauuacuguuuugcuaagccgcuuc

SEQ ID NO: 4788 - RNA, 62 nt, Human
ccauuaacagcgccucuuugauagguuacccugaugcugcuaaaguaaagccuuaagugugu

SEQ ID NO: 4789 - RNA, 62 nt, Human
ccauuauuauccacccugagccaccauaauaugcuguuuacauuuauuuucuucagccugug

SEQ ID NO: 4790 - RNA, 62 nt, Human
ccauucaugaaaaacguuuuuaaguauugcuuuuugcugcuauguucugcauugagccuagu

SEQ ID NO: 4791 - RNA, 64 nt, Human
ccauucauuauuccucaaguguuaauauacugacuuaugcaguauucaaaccaucuagugcaau

SEQ ID NO: 4792 - RNA, 61 nt, Human
ccauucccgcccuuugcagcagccccgcuaucuugagauuaguguugacagggaggggagg

SEQ ID NO: 4793 - RNA, 61 nt, Human
ccauucucucaccuauaaggccaauugccguuaacugugaacauacuuguuuuuaaguggu

SEQ ID NO: 4794 - RNA, 64 nt, Human
ccauugaaaguuaaacuauuuaacgugaaauccauuaacuggaauaauugaguuucuuuauuuu

SEQ ID NO: 4795 - RNA, 62 nt, Human
ccauugcacccugacugggcagucccuacagaaccaguguuaauuugaagggccuccacuca

SEQ ID NO: 4796 - RNA, 62 nt, Human
ccauuucccaucucagcuucaagggaggugucagcaguauuaucuccacuuucaaucucccu

SEQ ID NO: 4797 - RNA, 63 nt, Human
cccaaaaauaaaacuucaacagauugagagaguucacacuggagaaauacuuuccucuggcaa

SEQ ID NO: 4798 - RNA, 61 nt, Human
cccaaauguaggcaccuggcuccuccuugcuccccugcugaugguguccuaccccgaacuc

SEQ ID NO: 4799 - RNA, 64 nt, Human
cccaacaguaacuagggggccacauuccaucagugaaacuggaaagauugguguggcugagaau

SEQ ID NO: 4800 - RNA, 64 nt, Human
cccaagcauucccuuggugaauugucacgugaguggggccaguaagagugaagucugcuccuug

SEQ ID NO: 4801 - RNA, 62 nt, Human
cccaaggacaacggcacaaguagagagaaacuaccuaccucacuucaaauuauguuuggacu

SEQ ID NO: 4802 - RNA, 62 nt, Human
cccaaggacaacggcagaaguagagagaaacuaccuaccucacuucaaauuauguuuggacu

SEQ ID NO: 4803 - RNA, 61 nt, Human
cccaagguucugggugcaggagcgcucccuugaccugcugaaguccggaacguagucggca

SEQ ID NO: 4804 - RNA, 62 nt, Human
cccaaucagaauacggugguugagaaggaaccaguguuuacaaguaauaucagaaaguugaa

SEQ ID NO: 4805 - RNA, 61 nt, Human
cccaaucccugauuccucuccucuccugccgcaugagauuauuuuauuaaaaaacucaaag

SEQ ID NO: 4806 - RNA, 62 nt, Human
cccacaacaaaaacccaaguuuucugugcuacaugugcaauauuuguuaugaauguuaucac

SEQ ID NO: 4807 - RNA, 62 nt, Human
cccacacccuuauuuucagauucuggaucauucuuguuuacaacugaaauauauauaaccuc

SEQ ID NO: 4808 - RNA, 61 nt, Human
cccacacugcccaagaccaaaucccucacucaaccugcugagguguggauggggaaacaga

SEQ ID NO: 4809 - RNA, 64 nt, Human
cccacacuuguuuucuuuguuuuuguuuuuuauggcaacuggaaaguauuuacuaugggauuca

SEQ ID NO: 4810 - RNA, 64 nt, Human
cccacccagcgauuagggagcugggcuggccaguacagccaguggggagugggugggaggcacc

SEQ ID NO: 4811 - RNA, 63 nt, Human
cccacccuggccccccguauccccagcccuuggcaacacuggagugcacacgccgccacgguu

SEQ ID NO: 4812 - RNA, 64 nt, Human
cccaccucaugggugucacuguuuuuugaacagcagaacuggaaaagcccaaagauccagcaau

SEQ ID NO: 4813 - RNA, 62 nt, Human
cccaccucuccaggugucaaaggugaaccgaguccaguauuagcugaaugucauuucguaca

SEQ ID NO: 4814 - RNA, 61 nt, Human
cccacgguggucuccaggcccuggcuggggcucugagauuacggagugacuaccugcuggu

SEQ ID NO: 4815 - RNA, 61 nt, Human
cccacucaccaucaacucuguuagcccaauugcccugcugaacaacugccugaauacaggc

SEQ ID NO: 4816 - RNA, 63 nt, Human
cccacuccuuuccugucugugugguguaaguuaacacacuggagugugcuccaguuugcaggg

SEQ ID NO: 4817 - RNA, 63 nt, Human
cccacugaagauaccccaaaggaugcaagugccuacaguauuaucaggaggagaacaugaaaa

SEQ ID NO: 4818 - RNA, 62 nt, Human
cccacugccccuaaagccacagcagaagagccauucaucucauaaacaaaaaggaagaggaa

SEQ ID NO: 4819 - RNA, 63 nt, Human
cccagaaaauuuuaugauuguaacaaaaggaaguagugacuuaugaagguuuuguuucuugaa

SEQ ID NO: 4820 - RNA, 61 nt, Human
cccagaaauaaggaugccagugcccagaagcagugagauuagucuguguccacaagcagag

SEQ ID NO: 4821 - RNA, 62 nt, Human
cccagaacucugugcccaggagccaugccuugagcaguauuagccguguguguaugcaugug

SEQ ID NO: 4822 - RNA, 61 nt, Human
cccagaagaggccacugaaacggaaaggaaagcugagauuauccagcagcucuguucccca

SEQ ID NO: 4823 - RNA, 62 nt, Human
cccagauugcaaugcuaccaauaaagccgccugguguuuacaacuuaugaccgugcagaggg

SEQ ID NO: 4824 - RNA, 62 nt, Human
cccagcauacuuugugaaccuggcuccuucuucacuaccucagaucuaaucaauuaguccau

SEQ ID NO: 4825 - RNA, 62 nt, Human
cccagcccuguccucauccuagggccacuaggggaugaaggacccaucucaagucagcuccc

SEQ ID NO: 4826 - RNA, 64 nt, Human
cccagccucuagcuacccuguaucgaggcaaggggaggccaguaaaguuugccaagccugaucc

SEQ ID NO: 4827 - RNA, 61 nt, Human
cccagcuuaaaggggcuagagugaacuugggccacugugaagagaaccauaucaagacucu

SEQ ID NO: 4828 - RNA, 62 nt, Human
cccaggaccuggggguggcuuuaaaugaggcuugcaguguuaaaggucuuggauaagaaggg

SEQ ID NO: 4829 - RNA, 62 nt, Human
cccaggaggaggauugugcugauguagugaccaagugcaauaugggcgggcagucgcugcag

SEQ ID NO: 4830 - RNA, 63 nt, Human
cccaggcaccccccaacacuggaugcaaugguguuacacuggagcccgcugcaggccagcucu

SEQ ID NO: 4831 - RNA, 61 nt, Human
cccaggccuggguauccagggaggcucugcagcccugcugaagggcccuaacuagaguucu

SEQ ID NO: 4832 - RNA, 62 nt, Human
cccagggcacccccuuagugccuccagcuucugccuaccucacccccccuuucgugccccug

SEQ ID NO: 4833 - RNA, 64 nt, Human
cccagggccugauucaggacugacucuccaccauaaaacuggaagcugcuuccccuguaguccc

SEQ ID NO: 4834 - RNA, 62 nt, Human
cccagggucuagccgcugcccuggguccugccugcaguauuacagaggucgucgaaaggugc

SEQ ID NO: 4835 - RNA, 62 nt, Human
cccaguauggggaccauaguaucauucagugcauuguuuacauauucaaaguggugcacuuu

SEQ ID NO: 4836 - RNA, 62 nt, Human
cccaguccacuccuaacacuagcaucagucccacucaucucaggcugagccacaucucacuu

SEQ ID NO: 4837 - RNA, 62 nt, Human
cccagugaggcauggagguguuucugaauuuugucuaccucacagggauguugugaggcuug

SEQ ID NO: 4838 - RNA, 64 nt, Human
cccaguugaaauuuaggucugucaucuuaauauaucaugcaguaaaaggaagaaucuuuuuaaa

SEQ ID NO: 4839 - RNA, 62 nt, Human
cccauagggcugccugguugacucuccuucccauuguuuacagugaaggugucauucacaaa

SEQ ID NO: 4840 - RNA, 62 nt, Human
cccaucaaggccaccuccaccacaaccgaaaguaucaucucagggaaacuuaauuccugccc

SEQ ID NO: 4841 - RNA, 62 nt, Human
cccaucaccggaggagcuuccccggccgggagaccaguguuagaggauccaagcgaccuaaa

SEQ ID NO: 4842 - RNA, 62 nt, Human
cccaucaguguucuguuucuagaacuuguagaaccaguguuacuguuuguaucagggaagug

SEQ ID NO: 4843 - RNA, 62 nt, Human
cccaucccccgccuuuuuuuuuuuuuuuuuuaacugcugcuaucugcagcuggauacucuuc

SEQ ID NO: 4844 - RNA, 62 nt, Human
cccaucccggcagacccuuaucguugguguuuuccaguauuacaagaucaacuucugacccu

SEQ ID NO: 4845 - RNA, 64 nt, Human
cccaucgaugugccacgugggugucacgugucccagaugcaguauucggcagccagccggggag

SEQ ID NO: 4846 - RNA, 63 nt, Human
cccaugauugugaugagauugggaagcccacuguaacacuggagagcccagguuauaucagac

SEQ ID NO: 4847 - RNA, 63 nt, Human
cccaugguaccaaucaugaaucuuuguuucagguucaguauuauguaguuguucguugguuau

SEQ ID NO: 4848 - RNA, 62 nt, Human
cccaugucaggaugccauagugcuguggggagcacaguauuacccaguggguagggcuucug

SEQ ID NO: 4849 - RNA, 62 nt, Human
cccauuaaaugggaacauuacugucuuccccucccuaccucauggggaaugucugggaagcu

SEQ ID NO: 4850 - RNA, 64 nt, Human
cccauuauguacagaauaggaccuauccaguagccaggccaguaggcaguuggggaagguggga

SEQ ID NO: 4851 - RNA, 63 nt, Human
cccauucagcuguuuuaacacagaaauucaaaauagugacuuaacauggaagcuauuucucuc

SEQ ID NO: 4852 - RNA, 63 nt, Human
cccauucauccacucacacucccagccaccauguuacacuggacucuaagccacuucuuacuc

SEQ ID NO: 4853 - RNA, 61 nt, Human
cccauucuuuauaauccucuguaaaaagaucccugagauuauuccuucuucuaguuuuaug

SEQ ID NO: 4854 - RNA, 63 nt, Human
cccauuugacagaugaauuaaucguagagaguugagugacuuacccaagguugucuggauaag

SEQ ID NO: 4855 - RNA, 64 nt, Human
ccccacccccaaaguaagaagaaacauguuuccaguggccaguaugucuuucauugcuuugcac

SEQ ID NO: 4856 - RNA, 64 nt, Human
ccccaccccuccgcacugugaaagacuaacuccugcaacuggaaagcgggggcgcccgccgacg

SEQ ID NO: 4857 - RNA, 62 nt, Human
ccccacccuuuuuuuuugguuuuaaaucacuguacaguguuauuugauauuuuaauuuauuu

SEQ ID NO: 4858 - RNA, 63 nt, Human
ccccaccucuccaggugucaaaggugaaccgaguccaguauuagcugaaugucauuucguaca

SEQ ID NO: 4859 - RNA, 61 nt, Human
ccccaccuuccaaacaaaaaccugccauuuucaccugcugaugcugcccuggguccagacu

SEQ ID NO: 4860 - RNA, 62 nt, Human
ccccacucacuuugugugcucuuaaccuucugagugcugcuagcccagaccuguggacgagg

SEQ ID NO: 4861 - RNA, 61 nt, Human
ccccacucagggccaaccacagaaugcccccucccugcugagcugggucucuggggcuucc

SEQ ID NO: 4862 - RNA, 61 nt, Human
ccccacuucgaucugagcugcuucuuaacgguaugagauuauuuuacuccuucuucuuccu

SEQ ID NO: 4863 - RNA, 62 nt, Human
ccccacuuuaacuuucuaccaggacccccucccccuaccucaccuugcuauuuauugcugua

SEQ ID NO: 4864 - RNA, 63 nt, Human
ccccagaacucugugcccaggagccaugccuugagcaguauuagccguguguguaugcaugug

SEQ ID NO: 4865 - RNA, 62 nt, Human
ccccagagagauaaaauacauguauaguguuuuucaguauuacacauugauuuaaaaagauu

SEQ ID NO: 4866 - RNA, 61 nt, Human
ccccagcccucggguccauagagaugagcccacccugcugagaucugcuguccuguuucug

SEQ ID NO: 4867 - RNA, 63 nt, Human
ccccagcuccucuuguccucagcccaccccucauugugacuuaugaggagcaagccuguugcu

SEQ ID NO: 4868 - RNA, 62 nt, Human
ccccaggucugucucuugccuuuucuuggggcauauaagcuacugaguggaacauggagcug

SEQ ID NO: 4869 - RNA, 62 nt, Human
ccccagguucuggaacagcuuuuuguccuguacccaguguuacccucguuauuuuguaaccu

SEQ ID NO: 4870 - RNA, 62 nt, Human
ccccagugcaggguggcagcagaauguucuggaaaugaaggagauauugcuaggaaucucua

SEQ ID NO: 4871 - RNA, 62 nt, Human
ccccagugggccccaggcucgccugacugaagacaugaaggaccuagccuaggaguggucag

SEQ ID NO: 4872 - RNA, 62 nt, Human
ccccaucaggaccauuuuaucaaaguucguucauuuccguuaaccacauaacuaauaauuua

SEQ ID NO: 4873 - RNA, 62 nt, Human
ccccaucuguaaaaugaugguaauaauacuucaccuaccucauaggggagguugugaggcca

SEQ ID NO: 4874 - RNA, 61 nt, Human
ccccaugcccccagccuccuagccauaacccucccugcugaccucacagaucaacguauua

SEQ ID NO: 4875 - RNA, 62 nt, Human
cuuaaauaaaagaaaugcacaaugucuugguacuugcugcuauuuuacugucuuaauuaagu

SEQ ID NO: 4876 - RNA, 61 nt, Human
cuuaaauaauggugcuaauacugguagauauauacugugaagccugguucacauucaugcu

SEQ ID NO: 4877 - RNA, 63 nt, Human
cuuaaaugaacauuuucuacccuaauuucacuggagugacuuauucuaagccucaucuauccc

SEQ ID NO: 4878 - RNA, 62 nt, Human
cuuaaaugccuaccucugugcugaagcugacagacaguauuaacucuuaucaaggccaucuu

SEQ ID NO: 4879 - RNA, 63 nt, Human
cuuaacauuuuccugaggacuaggaagcucaucagacacuggaaugcagugauucuucuaaug

SEQ ID NO: 4880 - RNA, 64 nt, Human
cuuaacuaauuuuaaauaaggaaauaaguauguuagaugcaguagacgauacagguugcaugug

SEQ ID NO: 4881 - RNA, 62 nt, Human
cuuaacucagcagggauaucguacaucuauugcucuaccucagggguccagugauacccacu

SEQ ID NO: 4882 - RNA, 62 nt, Human
cuuaacuggacugaauucaaauauucuuucaacuucaucucaauagugauuuuuguaucaga

SEQ ID NO: 4883 - RNA, 62 nt, Human
cuuaagaccacucagcaugacgacugaguagacuuguuuacaucugaucaaagcacugggcu

SEQ ID NO: 4884 - RNA, 62 nt, Human
cuuaauagcaguguuggcuuuuauuuggauuuuuucaucucaguuuuuucuguggaaucucc

SEQ ID NO: 4885 - RNA, 62 nt, Human
cuuaaugcauauuucaguuuguguauccaugcaccuaccucagaaaacaaguaucgucaggu

SEQ ID NO: 4886 - RNA, 62 nt, Human
cuuaaugcauauuucggcuuguguauccaugcaccuaccucagaaaacaaguauugucaggu

SEQ ID NO: 4887 - RNA, 62 nt, Human
cuuaauguguauuucgguuuguguauccaugcaccuaccucagaaaacaaguauagucaggu

SEQ ID NO: 4888 - RNA, 62 nt, Human
cuuaauguguauuucgguuuguguauccaugcaccuaccucagaaagcaaguauagucaggu

SEQ ID NO: 4889 - RNA, 62 nt, Human
cuuaauucugcuagaguuaaccuugaguucagagcaguauuaaaugcgugcacuuucagguc

SEQ ID NO: 4890 - RNA, 63 nt, Human
cuuacccucuguaagauacugauucuuccuggggccaguauuaccuuguaugcaaauauuaca

SEQ ID NO: 4891 - RNA, 62 nt, Human
cuuaccgucaugucuugcaacaacccugugagggcaguauuaaugcccccuuacagcagaag

SEQ ID NO: 4892 - RNA, 63 nt, Human
cuuacuauuucauugugugcacccacccacccaccacacuggacuuuucuagagauggacagc

SEQ ID NO: 4893 - RNA, 62 nt, Human
cuuacuugccuggauugcuuuaaaauuaaccuuugugcaauaccaagaaaauagcucuuuaa

SEQ ID NO: 4894 - RNA, 62 nt, Human
cuuagaccugcagggaaugugccaugucuuucuucaguguuauggcuauagagagccuuugu

SEQ ID NO: 4895 - RNA, 61 nt, Human
cuuagauuuuguucuaaucaccacgugaaggaaugagauuagcaccacaaguuucaugcca

SEQ ID NO: 4896 - RNA, 61 nt, Human
cuuagcagguucugcuucacacuuguucuuugaccugcugacuugugacuugcagaaacau

SEQ ID NO: 4897 - RNA, 62 nt, Human
cuuaggaccugguaguuauuugcuugauuuuuuuuuccguuauuuucuacauaggcaaagag

SEQ ID NO: 4898 - RNA, 62 nt, Human
cuuaggggcagauccguuuucucacuguuggacucuaccucacuggucuggaaguccuccga

SEQ ID NO: 4899 - RNA, 64 nt, Human
cuuagugcuuugucuauucuuuauuucucucaggguggccaguauuuugacuuauuuauccugc

SEQ ID NO: 4900 - RNA, 62 nt, Human
cuuaguucuuauuugagucccuccaacucacuuguguuuacauccuccccagccacagcacg

SEQ ID NO: 4901 - RNA, 62 nt, Human
cuuauaauuugaggagggguuucccuuugggccucaguguuacaaauuacuagugcuauuuu

SEQ ID NO: 4902 - RNA, 62 nt, Human
cuuaucauuaggauaggguaagugaaguuugcuaugcugcuagcauccuaagaugauaccuu

SEQ ID NO: 4903 - RNA, 61 nt, Human
cuuauccaucaccaugcucccugaaagccuuuuugagauuaagaaauuuucuuaccaggag

SEQ ID NO: 4904 - RNA, 62 nt, Human
cuuaucccguuaguacaguauguaauagugggucugcugcuacuuucuguuuuaagguguga

SEQ ID NO: 4905 - RNA, 61 nt, Human
cuuauguggaaaccaaaaaccaacugcugggaaacugugaaaagcccuuuuacccacaagg

SEQ ID NO: 4906 - RNA, 62 nt, Human
cuuauuccuaguuguagggacuccuauuuuuaccuuccguuacaguguugauucauaagaaa

SEQ ID NO: 4907 - RNA, 62 nt, Human
cuuauucuuuuuguucacuggagagagagagaacuguuuacaguuaaucugugucuaauuau

SEQ ID NO: 4908 - RNA, 64 nt, Human
cuuauuuaaaauuuaaauaaggaauacauuuucaaaaugcaguaaucaaaaugugaucuagugu

SEQ ID NO: 4909 - RNA, 63 nt, Human
cuucaaagacaaguauagaagcuguauguguaagggugacuuaaaucauaugucacauugucu

SEQ ID NO: 4910 - RNA, 61 nt, Human
cuucaaagucuuauaaacauguugacucuuguuccugcugaguuacuuguucgaagcuuac

SEQ ID NO: 4911 - RNA, 62 nt, Human
cuucaaucagcuggcacacacuuguauagugaaauguuuacaugugggaaaacuccgccuua

SEQ ID NO: 4912 - RNA, 62 nt, Human
cuucacagaaagugcauuuuaaccaguacucugggugcaauaaauaauauguagaaauuuaa

SEQ ID NO: 4913 - RNA, 62 nt, Human
cuucacagucaucugagaaccuagaggaagaugcuguuuacaagacccacguggagaaggac

SEQ ID NO: 4914 - RNA, 62 nt, Human
cuucacauuaaaacuuuuuuccuuccucucuucuucaucucauuauccugauugacucugau

SEQ ID NO: 4915 - RNA, 62 nt, Human
cuucacggucacgcucguccguccugcaguggcguguuuacauggucacacguguguguauc

SEQ ID NO: 4916 - RNA, 61 nt, Human
cuucacuggggacacagaaaugcuacaaagccaccugcugaucaucaauuugcuugggaua

SEQ ID NO: 4917 - RNA, 63 nt, Human
cuucagaugagaccauuacaaacaaggccugcuugacacuggacacucgccaaugagacuccc

SEQ ID NO: 4918 - RNA, 63 nt, Human
cuucagccuccaucccuggccuccuccccucacacacacuggacuugguacaaaaugucggug

SEQ ID NO: 4919 - RNA, 62 nt, Human
cuucaguuuuggccuucugucagcagaaugauaagugcaauaguuguaaaucuacuugacac

SEQ ID NO: 4920 - RNA, 62 nt, Human
cuucauauccauuucuaauccaucaaacagcuuauguuuacauaaaauuuuaucauucacaa

SEQ ID NO: 4921 - RNA, 63 nt, Human
cuucauggacaauguuaacuguaaacgugauagcugugacuuacuugucuuacugccaaaucg

SEQ ID NO: 4922 - RNA, 63 nt, Human
cuuccacagaugaagcaaaacuagcccaaucaagagugacuuaacgauaccaauaguggauga

SEQ ID NO: 4923 - RNA, 62 nt, Human
cuuccacuucacucaacuuaagagaguucauugacaguguuaggaugugaaggcugggaaac

SEQ ID NO: 4924 - RNA, 62 nt, Human
cuuccagaagagacuagagaccuuaggccaggagaugaaggaguucaguagcaaagucacac

SEQ ID NO: 4925 - RNA, 61 nt, Human
cuuccagaauucucucucuuuuuaaaaccuagaugagauuaaccuguuuuuuauucaacug

SEQ ID NO: 4926 - RNA, 64 nt, Human
cuuccauaugaccucaugcaucuccaccugcucccaggccaguaagggaaauagaaaaacccug

SEQ ID NO: 4927 - RNA, 62 nt, Human
cuuccaugccaaagguuggagucugcuggugcgguguuuacacaccaggcagggcugucugc

SEQ ID NO: 4928 - RNA, 62 nt, Human
cuucccaacugggggugguuaaagggagccccacugcugcuaccuggggaauggggcaccug

SEQ ID NO: 4929 - RNA, 61 nt, Human
cuucccaucacuggagcaccaggcacgaacccaccugcugagagacccaaggaggaaaaac

SEQ ID NO: 4930 - RNA, 61 nt, Human
cuucccaugaugccgcucuucugucaucccgcuccugcugaaacaccucccaggggcucca

SEQ ID NO: 4931 - RNA, 64 nt, Human
cuuccccccaaccacaggaauggaggcgggacacagggccaguaggagcaauaggauuuuaaua

SEQ ID NO: 4932 - RNA, 62 nt, Human
cuuccccuugucccuggggcacucccccaggauugugcaauagucagagugucccuuuuugc

SEQ ID NO: 4933 - RNA, 62 nt, Human
cuucccucuggaaaugggguuucuuucucuccgccuaccucagcuaccuguucugagggucu

SEQ ID NO: 4934 - RNA, 62 nt, Human
cuucccuggccccgccggauguauaaauguaaaaaugaaggaauuacauuuuauaugugagc

SEQ ID NO: 4935 - RNA, 63 nt, Human
cuucccuugcuaaagcaugaaguuuggcauuuggcacacuggaagccugguugaaaugaaauu

SEQ ID NO: 4936 - RNA, 62 nt, Human
cuucccuuucucuuuuggacaauaguuaaauuagcaguauuaguuaugaguuugguugcagu

SEQ ID NO: 4937 - RNA, 62 nt, Human
cuuccuaagaugcaucucgcauaggcugccuaugaugaaggaccgugcaccuccacuccaac

SEQ ID NO: 4938 - RNA, 61 nt, Human
cuuccucucccaugggaauggaaugcucagacuccugcugagggagacaccagcaagccuc

SEQ ID NO: 4939 - RNA, 62 nt, Human
cuuccucugucuccuaagcuggagugcaguggcaucaucucagcucacugcaaccucugccu

SEQ ID NO: 4940 - RNA, 64 nt, Human
cuuccugauccuacucccuuuaggaagaacuucuuaaacuggaagcaggaaaaaaaaaaaccau

SEQ ID NO: 4941 - RNA, 61 nt, Human
cuuccuggggucuuugauauuuguuuguuacauccugcugaaguucgacuguguuuuuauu

SEQ ID NO: 4942 - RNA, 64 nt, Human
cuucuacuaaaauucacacugaaacuuuaucuucuaaacuggaaucauuacuuaauuuuaacua

SEQ ID NO: 4943 - RNA, 63 nt, Human
cuucuacuugguuuuuugaucaguguagcucaauugugacuuaaagaacagaaucuguccuuc

SEQ ID NO: 4944 - RNA, 64 nt, Human
cuucuaucacccuacauuccagcaucuuaccuucauaugcaguaaaagaaagaaagaaaaaaaa

SEQ ID NO: 4945 - RNA, 61 nt, Human
cuucucaagaccgaguguacaccacuuucccacacugugaacuaaugacaagugacuuauu

SEQ ID NO: 4946 - RNA, 61 nt, Human
cuucuccccagguguguuggggccuuggccuccccugcugaagguggggauugcccaucca

SEQ ID NO: 4947 - RNA, 62 nt, Human
cuucucuccuuuccucauccuaagugccuggcagaugaaggaguuuucaggagcuuuugaca

SEQ ID NO: 4948 - RNA, 64 nt, Human
cuucucugcacgcuugaccaaagcagugaugagggcggccaguaccugcggugugcgugguagg

SEQ ID NO: 4949 - RNA, 61 nt, Human
cuucucuguccacaccacgaguggcacaucccaccugcugauuccagcuccuggcccuccu

SEQ ID NO: 4950 - RNA, 62 nt, Human
cuucucugucucaugugugcucuucuucuuucuacaguauuauguacucuacugauaucuaa

SEQ ID NO: 4951 - RNA, 62 nt, Human
cuucuuauuuuuuugaaaagacaauuuuccauuucaguauuacauuuuaccaagaagucacu

SEQ ID NO: 4952 - RNA, 64 nt, Human
cuucuuguguuggaaacuuuguaauguaaaaggaaaaacuggaaauccccacgcccuguuuccc

SEQ ID NO: 4953 - RNA, 63 nt, Human
cuucuuucugauuuuucccuagggguuuggggugggugacuuaggggcggcuuuuguguucuc

SEQ ID NO: 4954 - RNA, 62 nt, Human
cuucuuuuguauuaggcuguguauugauaguuaauuccguuaaaaauuacuuggaaaacagu

SEQ ID NO: 4955 - RNA, 61 nt, Human
cuugaacacuuauugcacuuuuauuuauuguuaacugugaaaaguacguccuuuauugggu

SEQ ID NO: 4956 - RNA, 63 nt, Human
cuugaagacaauuuacagucuuugacuaagcauccacacuggaagaacaagauuugguuucug

SEQ ID NO: 4957 - RNA, 62 nt, Human
cuugaagaggagaaaugacauauccaagugccccaugaaggaggacaaaagcccaggaggca

SEQ ID NO: 4958 - RNA, 62 nt, Human
cuugaagguauaucuagguuuaugacaguaauuguguuuacauuuuauggugccuaguauug

SEQ ID NO: 4959 - RNA, 62 nt, Human
cuugaauaguucuacagucuuuuuuuuuuuuuaauguuuacaauuauccaguuuuagaagag

SEQ ID NO: 4960 - RNA, 62 nt, Human
cuugaauuguguacuuaguguguaugugauccuccaguguuaucccggagauggauugaugu

SEQ ID NO: 4961 - RNA, 61 nt, Human
cuugacagccaucuacgacuuuauuaacagguuacugugaagauuuugccacuaacucuag

SEQ ID NO: 4962 - RNA, 63 nt, Human
cuugacugaacaaaaggggaccaucaacauuguagacacuggacacuggaggccuuacagagu

SEQ ID NO: 4963 - RNA, 62 nt, Human
cuugacuucuuaaaaauauuuucuuucuuuuagugugcaauaagacaaacuaaggggaauuu

SEQ ID NO: 4964 - RNA, 62 nt, Human
cuugaggaccuuggccgcucuguaagcaucugacucaucucagaaaugucaauucuuaaaca

SEQ ID NO: 4965 - RNA, 62 nt, Human
cuugauacccaccaaaagaauguaucucgaaagaaugaaggaagaagaaaaaaggauccuug

SEQ ID NO: 4966 - RNA, 62 nt, Human
cuugauucacagauggaugugaccuaaaggauaaauaagcuauuacuuaugugcugaucucu

SEQ ID NO: 4967 - RNA, 62 nt, Human
cuugcauaugagagaaauaaaacauuuggcacauuguuuacaggugugacagaccucagggg

SEQ ID NO: 4968 - RNA, 62 nt, Human
cuugccccugucuggcccucuagaugauuuguagcaguguuauucuacacuuuuuaaaagaa

SEQ ID NO: 4969 - RNA, 62 nt, Human
cuugcccuuuuuccugggauguaacuaucuuacauguuuacauaagaaauaauaaacuggag

SEQ ID NO: 4970 - RNA, 63 nt, Human
cuugccuaauaccuuucuuggguauuguuuguaaugugacuuauuuaacgccuuuuuuguuug

SEQ ID NO: 4971 - RNA, 63 nt, Human
cuugccuacuuccuuucauagacaugaaaagacucacacuggaaggaaacacuaugaaugcaa

SEQ ID NO: 4972 - RNA, 62 nt, Human
cuugcuggaacauucuaacauuuacacuuuuguuauaagcuauuuaaaaccaguaaggagac

SEQ ID NO: 4973 - RNA, 62 nt, Human
cuuggacccagggccugagaccuuugugggauuugugcaauaaaguguuuuuauuuaaaacc

SEQ ID NO: 4974 - RNA, 62 nt, Human
cuuggcacuuguucuagagaaguguagaggaugauguuuacauaauuuuagcaccucaaggu

SEQ ID NO: 4975 - RNA, 62 nt, Human
cuuggcagcaaucaaagugccaguggcuccucgauguuuacauuuuuuucuauuuuguucag

SEQ ID NO: 4976 - RNA, 62 nt, Human
cuuggcaucucccuccuacccagcagcucugaugugcugcuauaccaggacaagugggugac

SEQ ID NO: 4977 - RNA, 61 nt, Human
cuuggccaaacaccccgcaggcaaagaugcaccccugcugauggagagccuucugcuucug

SEQ ID NO: 4978 - RNA, 61 nt, Human
cuuggggacacccgagccaggacacuacgcaucccugcugagugugcagaggcuagaggcu

SEQ ID NO: 4979 - RNA, 64 nt, Human
cuugguuccuuuucccuuuaguaggaggacagugcuaacuggaauuuuauaaggaguacccuuu

SEQ ID NO: 4980 - RNA, 63 nt, Human
cuugguuuuacaggucauuaccagucauuaaaguccaguauuacuaagguaagggauugagga

SEQ ID NO: 4981 - RNA, 62 nt, Human
cuugucaccaugagauagcauuagcugcccaggaugcugcuauauauauauauauauauaua

SEQ ID NO: 4982 - RNA, 61 nt, Human
cuugucauaaaaugcauacuguugauacaaaccacugugaacauuuuuuauuugagaauuu

SEQ ID NO: 4983 - RNA, 62 nt, Human
cuugucccauuucauucucuugcuuuuuuagcaugugcaauacuuucugugccaauagaguc

SEQ ID NO: 4984 - RNA, 64 nt, Human
cuugucccccgaccuucaggaauggcagccugcagcaacuggaacaaggccccaccguaaagcu

SEQ ID NO: 4985 - RNA, 61 nt, Human
cuugucucgugcagagggauuaaauuagaccugugagauuauauuuggaaaaauucauguc

SEQ ID NO: 4986 - RNA, 61 nt, Human
cuuguguucuguagacugccaucauugaugaucacugugaaaauugaccaagugauguguu

SEQ ID NO: 4987 - RNA, 64 nt, Human
cuuguugauuucaccaacuguugcuggaagauucaaaacuggaagcaaaaacuugcuugauuuu

SEQ ID NO: 4988 - RNA, 63 nt, Human
cuuguuggggcuucccugccccuccuggucugugucaguauuaccaccagacugacuccagga

SEQ ID NO: 4989 - RNA, 62 nt, Human
cuuguuugaguuuauggccaccuggaauuuucagucaucucaugauacaggcgggaggggca

SEQ ID NO: 4990 - RNA, 62 nt, Human
cuuuaaaaaggaauaauaauacaauauuuaaacaucaucucacccacccccacaaggggaga

SEQ ID NO: 4991 - RNA, 63 nt, Human
cuuuaaccacaagaauucagggaagguuauggggggugacuuaguuaucuggauaauacauau

SEQ ID NO: 4992 - RNA, 62 nt, Human
cuuuacuaaggauacuauucaaaaauuaacauuuucaucucaguaaguuuuuagaacaucaa

SEQ ID NO: 4993 - RNA, 62 nt, Human
cuuuagaaacacauaauuaacacuuaagguugggugcugcuaauucuuugcaaaaauccaaa

SEQ ID NO: 4994 - RNA, 63 nt, Human
cuuuagauggaaaauuaccucacaucuguuuucuucaguauuacuuaagauuguuuauuuagu

SEQ ID NO: 4995 - RNA, 62 nt, Human
cuuuauaggucuuuaaaaauuacuuuuauuauauuguuuacaaauauauuucaugcaagaaa

SEQ ID NO: 4996 - RNA, 62 nt, Human
cuuuauuaugaaacuuuaucacauucgaaauguuuguuuacagugggauuuuaggggggauu

SEQ ID NO: 4997 - RNA, 62 nt, Human
cuuuauuccauuugaaagugucaagcccauucagauaagcuauaaucuggucuuuaaggaac

SEQ ID NO: 4998 - RNA, 61 nt, Human
cuuucaauuaauagucaagaacauugaguccagugagauuaagugauuuuugcaggcuaug

SEQ ID NO: 4999 - RNA, 64 nt, Human
cuuucaccaaccaaauaguugccucucucgucaccaaacuggaaccucacaccagccggcaaag

SEQ ID NO: 5000 - RNA, 61 nt, Human
cuuucaucuuacagaggcuuagugaggcucagaugagauuauaucuguaaaaucccuuggu

SEQ ID NO: 5001 - RNA, 62 nt, Human
cuuuccagccugaagccugcuuaaacugugugaugugcaauaacugagcuuagaguuaggaa

SEQ ID NO: 5002 - RNA, 62 nt, Human
cuuuccccaacuacaaaaauguuuggcaacuuuguguuuacauuuaaagaucauuugcaccu

SEQ ID NO: 5003 - RNA, 62 nt, Human
cuuucccccccaaaugguugcguccuuugaaccugugcaauaugaggccaaauuuaaucuuu

SEQ ID NO: 5004 - RNA, 63 nt, Human
cuuucccgugcucuuugggcuccccagagaccugacaguauuagggagugaagggaggagggg

SEQ ID NO: 5005 - RNA, 62 nt, Human
cuuucuagagauuacuuguacuuucuaaucugcccaguguuacaacagacacuaccaugugg

SEQ ID NO: 5006 - RNA, 62 nt, Human
cuuucuauacauucagucaggcacugggaucaucuguuuacaggcauuauauuuauuuggca

SEQ ID NO: 5007 - RNA, 64 nt, Human
cuuucuccaacuguucacagcaaaugcuuggauuuuaugcaguaggcauuacuacaguacaugg

SEQ ID NO: 5008 - RNA, 62 nt, Human
cuuucuccagaaugaagagucccaauuuguauaucaguguuaagaagaaaacaaaacaaaca

SEQ ID NO: 5009 - RNA, 62 nt, Human
cuuucuuugcccauguaaaugagaacucaacugcuguuuacagugucagauuaacauuugaa

SEQ ID NO: 5010 - RNA, 62 nt, Human
cuuucuuuuuuuuuuuuuuuguguagaaaaauaggugcaauaaugaucaaaguuuugauguc

SEQ ID NO: 5011 - RNA, 61 nt, Human
cuuugauggagguuagggacugucacccucagcacugugaacauaccgggcgagaucauuc

SEQ ID NO: 5012 - RNA, 62 nt, Human
cuuugauuaccgacuacacaauuauguaccaucacaguauuaguggaaaaguaccaugugau

SEQ ID NO: 5013 - RNA, 62 nt, Human
cuuugccaaauagugaaaaguagagcaaucguguauaagcuaauguuuaaaagcaaaacugc

SEQ ID NO: 5014 - RNA, 64 nt, Human
cuuugcuagccucucuuacuaauggaauuauauacuggccaguaaaaugggccucccaauugcu

SEQ ID NO: 5015 - RNA, 62 nt, Human
cuuugcuucaggagucucagcuagggaguugaaguguuuacaucagacugucuugugcaauu

SEQ ID NO: 5016 - RNA, 63 nt, Human
cuuuggcagggaaaaagggcaauguugauuaaucucaguauuaaaccacauuaaucuguaucc

SEQ ID NO: 5017 - RNA, 62 nt, Human
cuuuggggccuuagucaccauccaugguaucaccucaucucacuuccugugagggacagggc

SEQ ID NO: 5018 - RNA, 62 nt, Human
cuuuggucaaucauaacaugcuguuuaaagcagcuguuuacaggauguguagugguaugccc

SEQ ID NO: 5019 - RNA, 62 nt, Human
cuuuguguguuagaguauuuguuuuaguaagaaauguuuacacagcuuguggaauuauuucg

SEQ ID NO: 5020 - RNA, 63 nt, Human
cuuuuacaguggacagccucuucucguuucagccucaguauuauguagggaccuuaugcaauu

SEQ ID NO: 5021 - RNA, 61 nt, Human
cuuuuauaauugcuuuugacaacuugucaugugacugugaauugaaauuauucacuuauuu

SEQ ID NO: 5022 - RNA, 62 nt, Human
cuuuuaugauaguuauuccaaauucaagaagaagcaguauuaacaucaauugaucgacacaa

SEQ ID NO: 5023 - RNA, 62 nt, Human
cuuuucaaaucucuuauuauauguuuccuuuuuuuguuuacauagggaacaauguuuauagu

SEQ ID NO: 5024 - RNA, 61 nt, Human
cuuuuccaccgaaagggagggcuugggaaucccugagauuagcuaaaguuaaguuguugga

SEQ ID NO: 5025 - RNA, 61 nt, Human
cuuuugagaaaguaugaaguuuugcagaaauugacugugaaaugucagagaaaaauaaaag

SEQ ID NO: 5026 - RNA, 62 nt, Human
cuuuugaguaaauuuaugcagcagaaacuauacaaugaaggaagaauucuauggaaauuaca

SEQ ID NO: 5027 - RNA, 62 nt, Human
cuuuuggagagaauguugauuggcaaaagcagcacaguauuaauauuuagaguaggaugcag

SEQ ID NO: 5028 - RNA, 62 nt, Human
cuuuugugcaacuguguuuugaauaaagccaugacaguguuaaaaaccauucuaagaccaga

SEQ ID NO: 5029 - RNA, 62 nt, Human
cuuuuguuauacacauuugcuuuguguaaauaaauguuuacaauuuuauaugaaagauggaa

SEQ ID NO: 5030 - RNA, 62 nt, Human
cuuuuuaauuuaaugugcucgcacuacaaugcaucaguauuaugauuccucuguacuuuccu

SEQ ID NO: 5031 - RNA, 62 nt, Human
cuuuuucaaggaaaaaaaguauugaguaaacaauuguuuacauauaucauuuaugcuuuuuu

SEQ ID NO: 5032 - RNA, 62 nt, Human
cuuuuucuuucucuuuuuuuuuuuuguauauuauuguuuacaauaaauauacauugcauuga

SEQ ID NO: 5033 - RNA, 62 nt, Human
cuuuuuuaacauguguuaaacagagaaaggguccaugaaggaaaguguaugaguugcauuug

SEQ ID NO: 5034 - RNA, 64 nt, Human
cuuuuuuaugaaaagggauauaaaggcaccgagcugaugcaguauuuguaauauuaaguugacc

SEQ ID NO: 5035 - RNA, 61 nt, Human
cuuuuuuggugucuaaaauguaagcaaaaaauuccugcugaaacauuccaguccuuucauu

SEQ ID NO: 5036 - RNA, 61 nt, Human
cuuuuuugucuggggccuggggaaagggcuuggacugugaaaagaaauguggccccuuucc

SEQ ID NO: 5037 - RNA, 62 nt, Human
cuuuuuuuaaucuuuuuaaaaacugcugugguuuugcugcuacacuaagaauugugauuugc

SEQ ID NO: 5038 - RNA, 64 nt, Human
gaaaaacaucuaccuaaaagaugguugucccuaaaaaacuggaaacaucugaaaugcucuauuu

SEQ ID NO: 5039 - RNA, 63 nt, Human
gaaaaauaguaugaaaauaaaauaaauguaugaaacaguauuaaugcagaaaugugcuacuaa

SEQ ID NO: 5040 - RNA, 62 nt, Human
gaaaacaaaguucauugaugucgaaggauauauacaguguuagaaauuaggacuguuuagaa

SEQ ID NO: 5041 - RNA, 64 nt, Human
gaaaacaugaauuuauauugaaauguguuuuugcagaugcaguaaguaugaaaaauauuuaauc

SEQ ID NO: 5042 - RNA, 62 nt, Human
gaaaaccagugaagugccacaugacagcaguguuaaguguuugaaaacguuucaaagcacau

SEQ ID NO: 5043 - RNA, 62 nt, Human
gaaaagaagaagaaaagagaagaaggagaaggagaugaaggaggaggaggaggagaaggaga

SEQ ID NO: 5044 - RNA, 62 nt, Human
gaaaagaauggacugaagucuaaaaacuggaauaaugaaggacacuaaaugccuuuauugua

SEQ ID NO: 5045 - RNA, 61 nt, Human
gaaaagagccauacugaaacaugucuuguacagccugcugagauggcgaaacccugugugu

SEQ ID NO: 5046 - RNA, 61 nt, Human
gaaaagaggcugccugcugggugucuguggaaaugagauuaaaaacuguacaaucucagau

SEQ ID NO: 5047 - RNA, 62 nt, Human
gaaaagauaauucuuucugggccuggugugggggcuaccucaacuaugugccuuaugguaac

SEQ ID NO: 5048 - RNA, 62 nt, Human
gaaaaguaggcauugaaacagacuuuuuuguagucaguguuaauaaaacggauccuguuugg

SEQ ID NO: 5049 - RNA, 64 nt, Human
gaaaauaaaucuuuauuuugaacuuuauaaaaagcaaugcaguaccccauagacugguguuaaa

SEQ ID NO: 5050 - RNA, 62 nt, Human
gaaaauauugaacauuuuaauauuaaaaauauuucaguguuaacaaaugugcaugaaguuua

SEQ ID NO: 5051 - RNA, 64 nt, Human
gaaaaugauugcauucucauugagcaugaaagucaaaacuggaauuuucuaaagcuuuggagaa

SEQ ID NO: 5052 - RNA, 61 nt, Human
gaaaauuaagucuucacuuucugugcaaguaauccugcugauccaguuguacuuaagugug

SEQ ID NO: 5053 - RNA, 62 nt, Human
gaaaauugaauuuucuucagacaaaacugcucuugugcaauauuuuaugcucagugagcaaa

SEQ ID NO: 5054 - RNA, 62 nt, Human
gaaaauuguuucuauguacuguauauuuuguaccuguuuacacuucuaauauugauauaacu

SEQ ID NO: 5055 - RNA, 61 nt, Human
gaaaauuuauaugguggaaugcgccauguauaaacugugaauuguauugacaaauaaaguu

SEQ ID NO: 5056 - RNA, 61 nt, Human
gaaaauuugaaaacuuacugaauauuuggugauacugugaaccauuauuaauuuuuaaggu

SEQ ID NO: 5057 - RNA, 63 nt, Human
gaaacaaaaguuuuaaaaguaguuuuaacaacuuuacacuggaaugauuuagcuuuguuauug

SEQ ID NO: 5058 - RNA, 62 nt, Human
gaaacagagcuaucuguuccucauagugccaguguguuuacauuuauaggaccacauauccc

SEQ ID NO: 5059 - RNA, 61 nt, Human
gaaacauaacacucuacauuacaaaguuuguuaccugcugaaaucaauguaacucaacuug

SEQ ID NO: 5060 - RNA, 61 nt, Human
gaaaccugccgccugcuggggaagucuggagccccugcugagacgauuuggaagucucguu

SEQ ID NO: 5061 - RNA, 62 nt, Human
gaaacgcaauuuuaccuaguuugcacuauaugaucaguguuacugccuauaaucuuauacaa

SEQ ID NO: 5062 - RNA, 62 nt, Human
gaaacguauuuggauuuuuccuaguaagaucacucaguguuacuaaauaaugaaguuguuau

SEQ ID NO: 5063 - RNA, 63 nt, Human
gaaacucuugcuauugaauugagaugauuaaaauggugacuuaauccguaguuauuuugcacc

SEQ ID NO: 5064 - RNA, 62 nt, Human
gaaagaaaagcaggggugcuuuuggaagcaguguuaguguuccucaaaagucggaacaauug

SEQ ID NO: 5065 - RNA, 62 nt, Human
gaaagaaaauuagaaaaucuguucauugaaauucuguuuacacuugucagaaauaagcauuu

SEQ ID NO: 5066 - RNA, 63 nt, Human
gaaagcaaucaguuaaugucuuuagcacacuaaagcaguauuaaacacagguacaaguuggaa

SEQ ID NO: 5067 - RNA, 62 nt, Human
gaaagcacuuuagggauuguagauggcuaacaagcaguauuaaaauuucaggagccaaguca

SEQ ID NO: 5068 - RNA, 64 nt, Human
gaaaggaagcuuuccgaggccugaguauugcaauacaugcaguaguacaucauuuuagcaacuc

SEQ ID NO: 5069 - RNA, 61 nt, Human
gaaaggacuaugcugcccuuuugacaucaaagaccugcugacaauggaggccacgccugcu

SEQ ID NO: 5070 - RNA, 62 nt, Human
gaaaggcuguuuuguucauuacagugagugcuguucaucucauggagugggaggagcacuaa

SEQ ID NO: 5071 - RNA, 64 nt, Human
gaaagggcugugcugagagcacuggccucugcacucaacuggaaccaauuuucaccaugauuuu

SEQ ID NO: 5072 - RNA, 63 nt, Human
gaaaggggggaaccagugaaaaugaaaggaaguuucaguauuagaugcacuuaaguuagccuc

SEQ ID NO: 5073 - RNA, 61 nt, Human
gaaaggguuaacucaagucaaauuguacuugauccugcugaaauacaucugcagcugacaa

SEQ ID NO: 5074 - RNA, 63 nt, Human
gaaaggucaguaaaauguagaauuauaagugccuagugacuuaauaggaggaaauauggaggg

SEQ ID NO: 5075 - RNA, 64 nt, Human
gaaaguggaaaaugaccucaaggaagcuacgggcacaacuggaagcuuuguagaaauuaaacau

SEQ ID NO: 5076 - RNA, 64 nt, Human
gaaaguuacaguauguguuuucacuuucgugcagauaacuggaaguaaagcggcaaacagugcu

SEQ ID NO: 5077 - RNA, 64 nt, Human
gaaauauaaauaauuuugucaauuauaccuaaauaaaacuggaaaaaaauuucuggaaguuuau

SEQ ID NO: 5078 - RNA, 62 nt, Human
gaaauauauuuuuccaucuguugcuuauuaauacuguuuacacauugggccuugaucaggag

SEQ ID NO: 5079 - RNA, 63 nt, Human
gaaauaugucuuuaaguauuuuagacauuccucgucaguauuaggaauuuccaugggaaaaga

SEQ ID NO: 5080 - RNA, 61 nt, Human
gaaauauuuuaacuaaagccuuuauucuauacaacugugaaauacagauuuuuacccuuuu

SEQ ID NO: 5081 - RNA, 64 nt, Human
gaaaucaacaguuauacuagaauauauuuuuuccagaugcaguaaaaguaaaauauuuaaucca

SEQ ID NO: 5082 - RNA, 62 nt, Human
gaaaucaauuuugaagaauugcacuauuugauaaugcugcuacuacaugagauaacucuggg

SEQ ID NO: 5083 - RNA, 61 nt, Human
gaaaucagcaacuugcaggaggcacagaaaacuccugcugauggucucagcuuccagcagc

SEQ ID NO: 5084 - RNA, 62 nt, Human
gaaaucaguuaagauaaagcugcauuguauauaagugcaauauauuuuugaaggucuguaaa

SEQ ID NO: 5085 - RNA, 62 nt, Human
gaaaucauacauaaaaauguagccugccuuacauauaagcuaauguagaaaaguuuagacuu

SEQ ID NO: 5086 - RNA, 62 nt, Human
gaaauccauuggaagggaaaaaagaaagugguaccaguguuaccagcucaacuaaaaccugc

SEQ ID NO: 5087 - RNA, 64 nt, Human
gaaauccccagggccugaaaccuacuccaccuuccuggccaguaccucaccccuugauugccag

SEQ ID NO: 5088 - RNA, 63 nt, Human
gaaaugaacccaguuuaagaauuugccaucaguagcaguauuaagcagugguuaaugucuuag

SEQ ID NO: 5089 - RNA, 63 nt, Human
gaaaugauauggccgguugcgguuguaggagaguugugacuuaggcaggagucgaccuccuca

SEQ ID NO: 5090 - RNA, 62 nt, Human
gaaauggccaggcacaaauuuagucuggucauuuuguuuacacauugggaaaaaaauuaguu

SEQ ID NO: 5091 - RNA, 62 nt, Human
gaaaugggaauguugaaggacaugaaagaaaggauguuuacacauuaagcaucaguucugaa

SEQ ID NO: 5092 - RNA, 62 nt, Human
gaaauuaccaggcacagauuuagucuugucauuuuguuuacacauuggggaaaacaauucag

SEQ ID NO: 5093 - RNA, 62 nt, Human
gaaauuuaaaugugagauugaacugaacaaacccucaucucaugaaggacggggugugugug

SEQ ID NO: 5094 - RNA, 64 nt, Human
gaacaaaaaugugcaguuaauacuuggcgcuugaaaaugcaguagugaauguggaaccaagccu

SEQ ID NO: 5095 - RNA, 63 nt, Human
gaacaaaaggggaccaucaacauuguagacacuggacacuggaggccuuacagagugcuagcc

SEQ ID NO: 5096 - RNA, 62 nt, Human
gaacaaagagauugugguggugcuaaaggaggccauaagcuacacagaggccuuggguguuc

SEQ ID NO: 5097 - RNA, 62 nt, Human
gaacaacuacugugaucaggcuauguauggaauacaguguuauuuucuuugaaauuguuuaa

SEQ ID NO: 5098 - RNA, 62 nt, Human
gaacacacacguuuucccuacagcagaggccaugcaguauuauauauucauuuugcagaauc

SEQ ID NO: 5099 - RNA, 62 nt, Human
gaacagguaccagauuuucagggguugauaugaaugcugcuaggcuuuuauuccacaaacuu

SEQ ID NO: 5100 - RNA, 64 nt, Human
gaacaguuccccacccagcgauuagggagcugggcuggccaguacagccaguggggagugggug

SEQ ID NO: 5101 - RNA, 62 nt, Human
gaacauugauauuuaacagaguuuuuagagauugucaucucauauauauaaaauggacacgu

SEQ ID NO: 5102 - RNA, 62 nt, Human
gaaccaagcuguuuaaaaacuacuuaucuccgcuaugaaggagaaguauuuucaaggaauau

SEQ ID NO: 5103 - RNA, 61 nt, Human
gaaccaguucugcaagugacuguguuuuguauuacugugaaaauaagaaaauguaguuaau

SEQ ID NO: 5104 - RNA, 61 nt, Human
gaaccaucuggcuucauucuucuuggacuugauccugcugauucuugcauuuccacauucu

SEQ ID NO: 5105 - RNA, 63 nt, Human
gaaccuauauaauuaugacccagugaugucuuuuggugacuuaagcuuaugaauucagguuac

SEQ ID NO: 5106 - RNA, 62 nt, Human
gaacgugcauccuuguaauaccugauugaucacacaguguuagugcuggucagagagaccuc

SEQ ID NO: 5107 - RNA, 62 nt, Human
gaacuaggcccugccucugucaccucauugguccaugaaggagcagccaggggugguggaag

SEQ ID NO: 5108 - RNA, 62 nt, Human
gaacuauucugggggcccugggaacuauuuucauuguuuacaaaagcccaacagaaacugug

SEQ ID NO: 5109 - RNA, 64 nt, Human
gaacucaguagaaaaacagacugaaauuuuaaagacaugcaguauuuguaucauuuuaaauucu

SEQ ID NO: 5110 - RNA, 61 nt, Human
gaacucuaaccccgguguaccuguauaaacugaacugugaaacuguuucgguuaucucugu

SEQ ID NO: 5111 - RNA, 62 nt, Human
gaacugaaugagaccaaaggaaaagcuuaacauacuaccucaagugaacuuuuauuuaaaag

SEQ ID NO: 5112 - RNA, 61 nt, Human
gaacugaucuuagcaccggccaaauaaauggaaccugcugagagagcugccagaauugugc

SEQ ID NO: 5113 - RNA, 61 nt, Human
gaacugauuuuuccauaaggaaaaugcuucuuuugagauuaauucuaauaacguauuugcu

SEQ ID NO: 5114 - RNA, 61 nt, Human
gaacuggugaaugggguaagcauuuucauucuuccugcugaaguaaagcagaaaguacugc

SEQ ID NO: 5115 - RNA, 62 nt, Human
gaacugucuucugucgagaaguaaaggaaacuucaugaaggauguagaagcuuagcugccuc

SEQ ID NO: 5116 - RNA, 62 nt, Human
gaacugugacugaaaucagagcugcugucuggggcaguguuaacuacacagaggcacauccu

SEQ ID NO: 5117 - RNA, 61 nt, Human
gaacuuguuucauaaauggauaucccuacuaugacugugaaaacaugucaagugucacauu

SEQ ID NO: 5118 - RNA, 62 nt, Human
gaacuuucaaagcuugcuauuaaaucauuuagaauguuuacauuuacuaaggugugcugggu

SEQ ID NO: 5119 - RNA, 62 nt, Human
gaagaaccuggaggacggaggaaaccaggggcaauguuuacaagacugguggacaaguguaa

SEQ ID NO: 5120 - RNA, 62 nt, Human
gaagaagcaagaccaagucuggcccuguccuuggucaucucaaagccaugccgaagcauuca

SEQ ID NO: 5121 - RNA, 61 nt, Human
gaagaaggcucccauuuucugauguuccgccccacugugaagagugugcucguuuuaaauu

SEQ ID NO: 5122 - RNA, 62 nt, Human
gaagaaucaggagaaugcauuucaugucugauucugcugcuaauuaagucaaucauuuaauu

SEQ ID NO: 5123 - RNA, 62 nt, Human
gaagacugcuuucuuuuauugauuaaagcaguaauguuuacauuauuugauuauauuuauug

SEQ ID NO: 5124 - RNA, 61 nt, Human
gaagagacagggcaagaugccucgguggagcugccugcugaagggugauauugaugaagac

SEQ ID NO: 5125 - RNA, 62 nt, Human
gaagagagacuaucgaucggccagguguauaauuaugaaggagaaaacuguucaagaacaaa

SEQ ID NO: 5126 - RNA, 62 nt, Human
gaagagaucuaugaaugggauauaaagcaauuuucaguguuacagguuuucuucuucuucuc

SEQ ID NO: 5127 - RNA, 54 nt, Human
gaagagcccgugcuggugaaaggaagccugcugaucccggaacuggccuugcgc

SEQ ID NO: 5128 - RNA, 61 nt, Human
gaagaguuaacuuuagaucuuugaaaacccaggacugugaagaaagucauaguagcagguu

SEQ ID NO: 5129 - RNA, 63 nt, Human
gaagauaaaauuacauaguauuaccuagacauagacaguauuaccuagguagaugcacugcuc

SEQ ID NO: 5130 - RNA, 62 nt, Human
gaagauaguaggaaauggaguacagaaaggcauacaguauuauguuacaguggagugcuuuc

SEQ ID NO: 5131 - RNA, 62 nt, Human
gaagaugacuaaccagaaaugcccgucauagcacuguuuacaguugcaaaaacugaagccaa

SEQ ID NO: 5132 - RNA, 63 nt, Human
gaagauggaccugcucuuauacuguugauuacuuucaguauuaauauacuauuccccaauuau

SEQ ID NO: 5133 - RNA, 62 nt, Human
gaagaugggagagagauuuaacuuuuuugccuugcuaccucaucagagacuucaagguggaa

SEQ ID NO: 5134 - RNA, 63 nt, Human
gaagauugcuuuuuuuuuuuuuuuaacuguaguuccaguauuauaugaugacuauugauuucc

SEQ ID NO: 5135 - RNA, 62 nt, Human
gaagcaaucgggauaaaacagcauuagauagucaugcugcuagaucuuuauuauggaaaaca

SEQ ID NO: 5136 - RNA, 54 nt, Human
gaagcaccugcccgcgugagggagcaccugcugagcccagccagaccgcggccu

SEQ ID NO: 5137 - RNA, 62 nt, Human
gaagcagaaccuacacuaaaaaacccaacagggcaacuggaaccccugccugaccuuaccca

SEQ ID NO: 5138 - RNA, 62 nt, Human
gaagcagcauuucuuguuaacuaguuaagcacuaugcugcuaguuacaguguaggcaccccg

SEQ ID NO: 5139 - RNA, 64 nt, Human
gaagcauggcccugacuucagaauuccagacuccagaacuggaagaauaaaugucuguuguuuu

SEQ ID NO: 5140 - RNA, 62 nt, Human
gaagccucggcuuucccucuggagccugggacccuguuuacaguugcacaucugggccccuc

SEQ ID NO: 5141 - RNA, 64 nt, Human
gaagccugaaauugugccguguugccuuauaugaauaugcaguaugggacuuugaaauaaugau

SEQ ID NO: 5142 - RNA, 61 nt, Human
gaagcgugagaaaugggcugggagugcuucuguccugcugacaccccgcggugggucccug

SEQ ID NO: 5143 - RNA, 63 nt, Human
gaagcuaugucucuagcagugaguacucauaaaggacacuggaucaaguucagccaccgaauu

SEQ ID NO: 5144 - RNA, 61 nt, Human
gaagcuuaugacauuuuacaguagcuaaaauguugagauuagagguacuuuuacuauucuu

SEQ ID NO: 5145 - RNA, 62 nt, Human
gaaggaauguauuuguugcuaaauuucguagcacuguuuacaguuuuccuccauguuauuua

SEQ ID NO: 5146 - RNA, 63 nt, Human
gaaggaauuaggaccuuuucuucaggauuacagguacacuggaugcagccaugcauggauggu

SEQ ID NO: 5147 - RNA, 64 nt, Human
gaaggauaucaacagcucaucugugaccaacagggcaacuggaaccuacacaaaccaauugcuu

SEQ ID NO: 5148 - RNA, 62 nt, Human
gaaggcccuggggauuccacuccaguaaaguagaaugaaggauacaaaugauaaaaauuaca

SEQ ID NO: 5149 - RNA, 63 nt, Human
gaagggagcacauaaccagcuguuuggcaugacaggugacuuaguauauuuguaauugguuuu

SEQ ID NO: 5150 - RNA, 63 nt, Human
gaaggggcaguuugagucugagcuagugcuccuaaacacuggacauuuuugcugugaaccaca

SEQ ID NO: 5151 - RNA, 64 nt, Human
gaaggggcuauccugggaccuccccagcccaggaaaaacuggaagccuucccccagcaaggcag

SEQ ID NO: 5152 - RNA, 61 nt, Human
gaaggggugucuacuuuuugaggcacaaagguuccugcugaauauaaguaaaacuaguuag

SEQ ID NO: 5153 - RNA, 62 nt, Human
gaaggugauuuaagggcccaggucagccacuguuuguuuacaaaaucagguaacuaacugca

SEQ ID NO: 5154 - RNA, 62 nt, Human
gaagguuucucuuuugcaauagaacgucauggaccaguguuaaaugugaguggaaggaguuc

SEQ ID NO: 5155 - RNA, 61 nt, Human
gaaguaaguuaugguacaucuguucuaugaaauacugugaaacaauaagguaucucuguau

SEQ ID NO: 5156 - RNA, 62 nt, Human
gaagucacugaaaauccaacuccaggagcuauggcaguguuaaugaacauauaucaucaggu

SEQ ID NO: 5157 - RNA, 62 nt, Human
gaagucagccugcucuacuacuaacaaacaggccugcugcuagaugaucucuaaugaccaau

SEQ ID NO: 5158 - RNA, 63 nt, Human
gaagucauguauaagauguuuucuaaaagacuuuucaguauuacaacuaauacuauuauuauc

SEQ ID NO: 5159 - RNA, 62 nt, Human
gaagucucacaguuggugauuucuccgcucuguggugcaauaucccuauuuguagggacuac

SEQ ID NO: 5160 - RNA, 64 nt, Human
gaagugaaaaucucccuguaauccucuuccuccauuaugcaguacacggacaccuggcuacaga

SEQ ID NO: 5161 - RNA, 62 nt, Human
gaagugcuauuaccuuucucaguuaccagaaucuugcugcuaaaguugcaagugauugauaa

SEQ ID NO: 5162 - RNA, 62 nt, Human
gaaguucuucaguuuuuaagugaggauaucgugacaguauuaaaacaucgcaauaauguucc

SEQ ID NO: 5163 - RNA, 62 nt, Human
gaauaaacguaaaggacaaguaaacaauuugaugauaagcuacaguuuuucuuagaaaguaa

SEQ ID NO: 5164 - RNA, 62 nt, Human
gaauaaagagaaaagccuucaugaccuccuccuguguuuacaagacuccuccgagucuccua

SEQ ID NO: 5165 - RNA, 62 nt, Human
gaauaaauaagucacagagaauguaaauuuuguacaguauuagaauguguaaaugaagcuug

SEQ ID NO: 5166 - RNA, 61 nt, Human
gaauauauuuuuaaaguaaauauauuguaauguacugugaacuuguagggugcuuuucaac

SEQ ID NO: 5167 - RNA, 62 nt, Human
gaauaugacuuuuuauaaaauggcuguaaucauuuguuuacauuugaugcaugucuuuuaaa

SEQ ID NO: 5168 - RNA, 62 nt, Human
gaauauuauacuacuacugguaaaaugcagaagacaguguuaauguguuugguuuggggacu

SEQ ID NO: 5169 - RNA, 63 nt, Human
gaaucaaaaucacauuggguuauguaaucauuuaacaguauuaauuuuuccaaaacaucaaua

SEQ ID NO: 5170 - RNA, 63 nt, Human
gaaucaaccauuucaugagguuguacuguaauuauacacuggaauauucagguagucaucuuu

SEQ ID NO: 5171 - RNA, 63 nt, Human
gaaucacuuuccuaucaucuaaaccaaguuccuucacacuggaguauuuugucacuucucccc

SEQ ID NO: 5172 - RNA, 62 nt, Human
gaaucagaacuuuuauauaaaacccaaacacugauguuuacacagaauuucauauucugcaa

SEQ ID NO: 5173 - RNA, 62 nt, Human
gaaucagagaaaaucauaugccaaagccaacugccaguguuagaccucuuuuuccauaaaga

SEQ ID NO: 5174 - RNA, 62 nt, Human
gaaucagaggcuaaaaauauuaccccauauguuccaguauuagucauggauugcaaaggcuu

SEQ ID NO: 5175 - RNA, 63 nt, Human
gaaucaguccugggaauagagaguguccuuugugccaguauuacaagaagcccaaacuuuauu

SEQ ID NO: 5176 - RNA, 61 nt, Human
gaaucauaguaugaaaugcuacaguuuaugcaaacugugaauucccagagcagacuuaccu

SEQ ID NO: 5177 - RNA, 61 nt, Human
gaaucaugauuucuaagacuucugaucaaaaauacugugaaauaaagaauguuaaucaacu

SEQ ID NO: 5178 - RNA, 62 nt, Human
gaaucauuggcuuuuauaccuuucuugguuugacgugcaauaaagaagcacauuauuuuagc

SEQ ID NO: 5179 - RNA, 62 nt, Human
gaauccccuuuguaaaacuaugaauccaaauaaauguuuacaaagugguuugaagcuuuguu

SEQ ID NO: 5180 - RNA, 62 nt, Human
gaaucccuugggggagauauuaggagugcucuguuguuuacaaacucagguacccgcagggc

SEQ ID NO: 5181 - RNA, 62 nt, Human
gaaucuccaggccucacgagguccccuguggggaugcugcuauuucuaagaugcaaauugca

SEQ ID NO: 5182 - RNA, 63 nt, Human
gaaucuguguaauugggcccagauguggguuugcucaguauuaguagacaaggucuuuguuca

SEQ ID NO: 5183 - RNA, 62 nt, Human
gaaugaggcacccaccuuugcagcuaaggagacaaugaaggacucucccugggugcccaaug

SEQ ID NO: 5184 - RNA, 61 nt, Human
gaaugauaucuuguaaauaaagacauucagcacacugugaaaauguauuugugcaccugcu

SEQ ID NO: 5185 - RNA, 63 nt, Human
gaaugauucacacguggcaccccauacuagaauucacacuggagagaaaccuuacaagugcaa

SEQ ID NO: 5186 - RNA, 63 nt, Human
gaaugccauuaguguagaugucugugccacaucugacacuggaguagugauaacaaauagccc

SEQ ID NO: 5187 - RNA, 62 nt, Human
gaaugcuucaugcccaaaauaccagccuguuuagcaguguuacacuguuugaucugcgggca

SEQ ID NO: 5188 - RNA, 62 nt, Human
gaaugggguggaacacagcauuuugucaagcacugugcaauauuccauauuuuuccccacua

SEQ ID NO: 5189 - RNA, 61 nt, Human
gaauguaccuccugcagagacaaaucuucugcaugagauuacugaugcuucacuugcacuc

SEQ ID NO: 5190 - RNA, 63 nt, Human
gaaugugacuguucggagaugaggccuuuaaagaggugacuuaaguucaaaggaggcuguuag

SEQ ID NO: 5191 - RNA, 62 nt, Human
gaauguuagucaucguuauuauauucaucaucaucaguauuauuauuuguagaaaggcuuuu

SEQ ID NO: 5192 - RNA, 64 nt, Human
gaauuaacaaaauauuaucuuuauucaugaguuggaaacuggaaaaaggcuucuugaaguaaau

SEQ ID NO: 5193 - RNA, 61 nt, Human
gaauuagucuccauugguggacuuccagaguuuugagauuaaacuuugagaggugagaagc

SEQ ID NO: 5194 - RNA, 62 nt, Human
gaauucuaugagcaugccaaggcucugugggaggaugaaggagugcgugccugcuacgaacg

SEQ ID NO: 5195 - RNA, 62 nt, Human
gaauugaggaaaacucugagcauuuuuaaaaguuuguuuacaauuccacaagcaaaagcucu

SEQ ID NO: 5196 - RNA, 62 nt, Human
gaauugccugagcccaggaguucaagaccagcuugugcaauauagggagacuccggcucuac

SEQ ID NO: 5197 - RNA, 62 nt, Human
gaauugcuugguggaacauaugcuuucacuguuugugcaauaugcauuuauuucuuauauga

SEQ ID NO: 5198 - RNA, 61 nt, Human
gaauuguuggguuaauauguuuuguaauaucgaugagauuaagugguugauaguauuguuc

SEQ ID NO: 5199 - RNA, 63 nt, Human
gaauuuauguacucuauaacggugugaaugauuaccaguauuaagccauuuucucaucugaua

SEQ ID NO: 5200 - RNA, 62 nt, Human
gaauuugguugguuuugguguuguacagcucacauguuuacacacucagugcccuaauuucc

SEQ ID NO: 5201 - RNA, 62 nt, Human
gaauuuucucuugcuuucucaauaaagucucuauucaucucauguuuaauuuguacgcauag

SEQ ID NO: 5202 - RNA, 64 nt, Human
gaauuuugaaguuaaacuaaauuuugguaccauaccaacuggaauuuaggcuuuaaaaauaaug

SEQ ID NO: 5203 - RNA, 62 nt, Human
gaauuuugcaagcugauuguuaauuaaguacagucaguauuaaaaaugauauacauuuacaa

SEQ ID NO: 5204 - RNA, 64 nt, Human
gacaaaagccaggcucaacuuauagaauguuuuggaaacuggaaguaaugauacauuucacuuc

SEQ ID NO: 5205 - RNA, 62 nt, Human
gacaaaauguacuucccuuaacuuucauuaauaguguuuacaucuuuugucagcacagcaaa

SEQ ID NO: 5206 - RNA, 62 nt, Human
gacaaacaaacaacaucaaggcaaauccaauaaucaguauuaccauggcaaaaagaggaaac

SEQ ID NO: 5207 - RNA, 63 nt, Human
gacaaagaaucgcaaauucuucaaaugacuauuaucaguauuauuaacaugcgaugccacagg

SEQ ID NO: 5208 - RNA, 64 nt, Human
gacaacaaauagagaagacuggcucuguuaguaauuaugcaguauguacucuauuuaaggaucu

SEQ ID NO: 5209 - RNA, 62 nt, Human
gacaacuaccaauaaacagacaggggaaggucuuucaucucagccauuuucucuuccccccg

SEQ ID NO: 5210 - RNA, 62 nt, Human
gacaaggaguucuggugacaagcuauaccuaauuauaagcuauaaaacaauagauaugagug

SEQ ID NO: 5211 - RNA, 62 nt, Human
gacacacaguaucauuaauuucugaauuguauuucaguguuauuuuuuguuugugaccacua

SEQ ID NO: 5212 - RNA, 64 nt, Human
gacaccaaagauagaggcaauggauagaaauuuuuaaacuggaaagaaaaccugaauuacacua

SEQ ID NO: 5213 - RNA, 62 nt, Human
gacacucaaaauccuucagaucuggaaaccggcucaguauuaacccuaccuuugguuguccu

SEQ ID NO: 5214 - RNA, 62 nt, Human
gacacugacagauguguuugcaaggauacggcuucaguauuacuaauuuccauguguaucug

SEQ ID NO: 5215 - RNA, 61 nt, Human
gacacugguggggauaggccagccgcgcaucagacugugaaccccacgaaggagcccauug

SEQ ID NO: 5216 - RNA, 64 nt, Human
gacacuugguaauagacuucagugaacucuguaugaaugcaguagugugugugcaaaauccgcu

SEQ ID NO: 5217 - RNA, 64 nt, Human
gacagagaccucuggucagcaaacuggaacucaguaaacuggagaaauaguaucgaugggaaga

SEQ ID NO: 5218 - RNA, 62 nt, Human
gacagauucugcccagucucugggcauccauaauugcugcuaaccuagacauuucauaguua

SEQ ID NO: 5219 - RNA, 61 nt, Human
gacagucaugugacccaggcgcugggggcuggaccugcugacauaguggauggacagaugg

SEQ ID NO: 5220 - RNA, 62 nt, Human
gacagugcccugagaccucuagagaaaagauguuuguuuacauaagagaaagaggccagaca

SEQ ID NO: 5221 - RNA, 63 nt, Human
gacauaccugacaauguuaaucugcaacugggauuacacuggaacuacaggaaugauuccuuu

SEQ ID NO: 5222 - RNA, 61 nt, Human
gacaucaguaugugauuucuggguaugugguagugagauuaaggagcagcuuuuuuuuuuu

SEQ ID NO: 5223 - RNA, 62 nt, Human
gacauggcccugcguugcaaagcugagaaguaauaugaaggagcguuuuguaaguuugaauc

SEQ ID NO: 5224 - RNA, 63 nt, Human
gacauuuugccaaaauuauuaauauaagaagcuuucaguauuagugaugucaucugucacuau

SEQ ID NO: 5225 - RNA, 62 nt, Human
gaccagagaccaccucuguggccaccucagauagucaucucaguccaaggaucccaaaacac

SEQ ID NO: 5226 - RNA, 64 nt, Human
gaccagcauuauauuuauuuuucuuuuauuauucagaugcaguagcauugcuuauguuacauau

SEQ ID NO: 5227 - RNA, 62 nt, Human
gaccaucggcucuggggaauccuggugaauauagugcugcuauguugacauuauucuuccua

SEQ ID NO: 5228 - RNA, 62 nt, Human
gaccccagcgagaccugcagaacauuacagcagaaugaaggagagccagaggaagaggcaga

SEQ ID NO: 5229 - RNA, 62 nt, Human
gaccccgauuggugagggcucugcauaugccuguaugaaggagauacaggugugugugcaca

SEQ ID NO: 5230 - RNA, 63 nt, Human
gacccggggaggggucccgagaggcuccccaugcaacacuggaaaugacuguuccagagagcg

SEQ ID NO: 5231 - RNA, 63 nt, Human
gacccgugaacaacuuugucagguucacguccuauaacgguuaaaaaacacacacacacauac

SEQ ID NO: 5232 - RNA, 62 nt, Human
gacccuacaacugcccugggacauuucacuguaccaguauuaacugcaaacagcaauaauug

SEQ ID NO: 5233 - RNA, 63 nt, Human
gacccuuuuucauuauuucauuugcucucauauaucaguauuauuuuugagcauuuuguuaca

SEQ ID NO: 5234 - RNA, 62 nt, Human
gaccuaugaauuuguacuuuuugccaucucacccuguuuacaugccauagguguucuggucu

SEQ ID NO: 5235 - RNA, 62 nt, Human
gaccucaucaggaugaacccaggacgcuucugaaugcugcuacuuaauuccuuucucauccc

SEQ ID NO: 5236 - RNA, 62 nt, Human
gaccuccccaucuguggaauggggucaauaccaccuaccucacagggguguugugaggacug

SEQ ID NO: 5237 - RNA, 61 nt, Human
gaccugacccgucgcuuaccagagccagaaguuccugcugaggacaugaggacccgucuuu

SEQ ID NO: 5238 - RNA, 62 nt, Human
gaccugccaggaggcagccacaggcgagugccagcaguguuacugccgccccauguggugcc

SEQ ID NO: 5239 - RNA, 63 nt, Human
gaccuuagguuuauuaaaggcuagguuuauuugggcaguauuagaaacaaaaucauggaucaa

SEQ ID NO: 5240 - RNA, 61 nt, Human
gaccuuaucaaaacuacucacuccaccugggccccugcugaagcccuauuuugaaauuucc

SEQ ID NO: 5241 - RNA, 62 nt, Human
gaccuucagagacagucuacgccuuaacaagcacaugaaggaaacuauuuugaauguucucu

SEQ ID NO: 5242 - RNA, 62 nt, Human
gaccuugaacaagucagcaucucugccuuucaaaaugaaggaacauuguucucuauccuccc

SEQ ID NO: 5243 - RNA, 63 nt, Human
gaccuugcucuagggcacucugccucuacccuaggacacuggaaugcccugggagcccccucc

SEQ ID NO: 5244 - RNA, 61 nt, Human
gacgaaaacuucugaguuacagcucaggaaaagccugcugaauuuauguuguaagcauuac

SEQ ID NO: 5245 - RNA, 62 nt, Human
gacgaggaaaagacaggguuuggagucuccucaacaguguuaaaagaggaagugaccucaca

SEQ ID NO: 5246 - RNA, 64 nt, Human
gacgcgacaggccuguggcccugcgcaugcugaaauaacuggaacccagccucuccuccuacac

SEQ ID NO: 5247 - RNA, 64 nt, Human
gacgcugcugauucgggcuguggccuccacguauuuaugcaguacagucugccugacgccagcc

SEQ ID NO: 5248 - RNA, 62 nt, Human
gacggcugcugcccuucucugggcauguucugaauguuuacacugguaccuucugguaucuu

SEQ ID NO: 5249 - RNA, 63 nt, Human
gacgggcuggagcugggcuccugccuuugcugcuaacacuggaggcgguguuccuaacugcag

SEQ ID NO: 5250 - RNA, 63 nt, Human
gacggggugaagcuauuccccacacucuccugugaacacuggagucuugcaagacccagggag

SEQ ID NO: 5251 - RNA, 64 nt, Human
gacggugauucuugcccuuaauucauaauugaaaauaugcaguaacaagcauaaaacucacauc

SEQ ID NO: 5252 - RNA, 64 nt, Human
gacgguugggggcugggagcccugggcguguaguguaacuggaaucuuuugccucucccagcca

SEQ ID NO: 5253 - RNA, 62 nt, Human
gacgugagacugacauaugccauuaucucuuuuccaguauuaaacacucauaugcuuauggc

SEQ ID NO: 5254 - RNA, 63 nt, Human
gacgugcugcagcccuccugucccuuccccccagucaguauuacccugugaagccccuucccu

SEQ ID NO: 5255 - RNA, 61 nt, Human
gacguggggcuaagcaugcagagcucccuguaaacugugaagugugauacaaauguaaaug

SEQ ID NO: 5256 - RNA, 62 nt, Human
gacuaauuccaaccuucuaaauuuggcuaguaaagugcaauaaaggcauugauaaguucugu

SEQ ID NO: 5257 - RNA, 62 nt, Human
gacuacaggaagggcagagaauacugacgguuaccaguauuaacccuucaucuguucuugaa

SEQ ID NO: 5258 - RNA, 62 nt, Human
gacuacaggcaugcgcagccacuaugcccggccaauaagcuauauuuauucuuauuugaugu

SEQ ID NO: 5259 - RNA, 64 nt, Human
gacuauauuuucccuuauuacugcuugcaguaauucaacuggaaauuaaaaaaaaaaaacuaga

SEQ ID NO: 5260 - RNA, 63 nt, Human
gacucaaagugauauuuguacaccaguguuuguagcaguauuauucacaauagccaaaaggug

SEQ ID NO: 5261 - RNA, 61 nt, Human
gacucacugggacagaacuuucaaguuccuucaacugugaaaagugucuuuuuggacaaac

SEQ ID NO: 5262 - RNA, 62 nt, Human
gacucagguuguaguaaagaaauuuaaaagacacuguuuacaagaaaaaaugaauuuuguuu

SEQ ID NO: 5263 - RNA, 61 nt, Human
gacucgaccaucccucaccccaccaaggaccacacugugaagugauaacugccuugaaccc

SEQ ID NO: 5264 - RNA, 62 nt, Human
gacucuacuccuaaaagggaaaaaacaauauccuuguuuacagaagagaaacaaacaagccc

SEQ ID NO: 5265 - RNA, 61 nt, Human
gacucuggccucuccagacuaauguuccugucaccugcugagcuuucccagugucacuucu

SEQ ID NO: 5266 - RNA, 63 nt, Human
gacugaaagccaggacaucugaguaccuaucucacacacuggaccaccagucacaaagucugg

SEQ ID NO: 5267 - RNA, 62 nt, Human
gacugaaagcuuugaugaaauuuguuuuuguauggugcaauaugacagccugucauugaauc

SEQ ID NO: 5268 - RNA, 62 nt, Human
gacugacaagcauaaaaggcuaacuuguggauaguguuuacaaaaguacaaaaguacuacuu

SEQ ID NO: 5269 - RNA, 62 nt, Human
gacuggaacuagugagcuguguccauggugugucaugaaggauguaccccagagaguaacau

SEQ ID NO: 5270 - RNA, 64 nt, Human
gacuggagcuguuugguuuucucgcauuuuccaccaaacuggaagcuguuuuugcagccugagg

SEQ ID NO: 5271 - RNA, 63 nt, Human
gacugggaacuccuuagagagggccuugcagcuuuacacuggaauaagucugccucugccucu

SEQ ID NO: 5272 - RNA, 62 nt, Human
gacuguucagccuuuauauaaacuaaauuugucuucaucucaaccagcuaaugguaggucuu

SEQ ID NO: 5273 - RNA, 64 nt, Human
gacuuagaccuauacugaaagaucucugucacauccaacuggaaauuccaggaaccaaaaagag

SEQ ID NO: 5274 - RNA, 64 nt, Human
gacuucacccgggggugaagggguaaacccgacugaaacuggaacccuuguccuccgcuggugc

SEQ ID NO: 5275 - RNA, 62 nt, Human
gacuugaagaauacauauacuuauauucggggauaugaaggauucaaugaaugaucucuaga

SEQ ID NO: 5276 - RNA, 62 nt, Human
gacuugccaaacagucuuuuaugaaggaaaguuacaguauuaauuuuugaaaagguuuuuuu

SEQ ID NO: 5277 - RNA, 63 nt, Human
gacuugcgcugcuauuuuuaaauagaccagagaguacacuggagaaggcauugagugguuuua

SEQ ID NO: 5278 - RNA, 62 nt, Human
gacuugcuaaaauauaaaucagccucugcaaaacuguuuacauauuuauugguuuacauauu

SEQ ID NO: 5279 - RNA, 64 nt, Human
gacuuuaagucaguugguuuuuauuagcugcuugguaugcaguaacuuggguggaggcaaaaca

SEQ ID NO: 5280 - RNA, 61 nt, Human
gacuuuagcccaccaguuugucugguugacuaaccugcugagagcuaaaauuggcacccau

SEQ ID NO: 5281 - RNA, 63 nt, Human
gacuuuauaugaaaaugaauauuuuacaguuugcacaguauuauuuuacagaaaaggaaucag

SEQ ID NO: 5282 - RNA, 62 nt, Human
gacuuucucuuggacauuguaaacguauuuugaucaguguuacaaggguauccugugcuaug

SEQ ID NO: 5283 - RNA, 62 nt, Human
gacuuugcuaauggcuauucuccaauuuguuccaauaagcuaagggcuuuucauacacagga

SEQ ID NO: 5284 - RNA, 62 nt, Human
gacuuuucaaguuaccuuccuugggaaguuugugcaguguuauaguuuaguuuagcuccucu

SEQ ID NO: 5285 - RNA, 61 nt, Human
gagaaaaauuuuguuaggccacaaaaacacugcacugugaacauuuuagaaaagguauguc

SEQ ID NO: 5286 - RNA, 62 nt, Human
gagaaaauaugcagaauaacuggucuuguuaagagugcaauauuauauuuuuauguaaaaau

SEQ ID NO: 5287 - RNA, 62 nt, Human
gagaaaauuguauaaccauccugcuguuccuuuagugcaauacaauaaaacucugaaauuaa

SEQ ID NO: 5288 - RNA, 62 nt, Human
gagaaacacagugcauuauuuauugcggaaucauugcugcuaaauaacuacugucuguuuau

SEQ ID NO: 5289 - RNA, 62 nt, Human
gagaacaguacuggccuucaguauaugcauagaaugcugcuagaagacaagugauguccugg

SEQ ID NO: 5290 - RNA, 61 nt, Human
gagaaccaagacaggcaucccuggguggccuuuccugcugacacuccacgagcugacccag

SEQ ID NO: 5291 - RNA, 62 nt, Human
gagaaggggagaaauguacuuggaaauuaauguauguuuacaucucuuugcaaauuccugua

SEQ ID NO: 5292 - RNA, 61 nt, Human
gagaaggugugacacugccuauaaauguuucuuacugugaaacacucugaaugugaggcug

SEQ ID NO: 5293 - RNA, 63 nt, Human
gagaaguaagaccguaucugccagcguuucucaccacacuggagagcagcugcucuggagcag

SEQ ID NO: 5294 - RNA, 62 nt, Human
gagaaguuaaacugugguucaguauuuaaacugccaguguuauacgucucaugcucugugug

SEQ ID NO: 5295 - RNA, 63 nt, Human
gagaaguucauauuuugugacaucugcauugauuucaguauuacugaugguacuguuauucau

SEQ ID NO: 5296 - RNA, 61 nt, Human
gagaaguucucagggacaauaauagcaggggguccugcugaagaaaaacugggagauggcu

SEQ ID NO: 5297 - RNA, 61 nt, Human
gagacaagggguaggugggagggucccccagucccugcugaccccagugugucuccccgga

SEQ ID NO: 5298 - RNA, 63 nt, Human
gagacaggauuauagugccuuaaccgauauauuuugugacuuaaaaaauacauuuaaaacugc

SEQ ID NO: 5299 - RNA, 62 nt, Human
gagacauaaaaccuuuuuuuaauaauaaaauauugugcaauauauucaaagaaaagaaaaca

SEQ ID NO: 5300 - RNA, 61 nt, Human
gagacaucaaaaccacccuaaccucgcucgaugacugugaacugggcauuucacgaacugu

SEQ ID NO: 5301 - RNA, 62 nt, Human
gagaccaagcaucuaucugauagaagcacauggagugcaauaggacauugugagaaggaauu

SEQ ID NO: 5302 - RNA, 57 nt, Human
gagaccccgugcccuuuaaaaccggcauuugcugcuaaaggauacccagaacccuca

SEQ ID NO: 5303 - RNA, 63 nt, Human
gagacuaacuccuaggaguugcuuuacucugucaggugacuuaagucacugggauucacuaau

SEQ ID NO: 5304 - RNA, 62 nt, Human
gagagaagugugcaauagucuggaauaaauauaaaugaaggaggggccugggggcccccugg

SEQ ID NO: 5305 - RNA, 62 nt, Human
gagagagaacagugcagccccauuuccgguccugcuaccucaccuagauguugugaggauuc

SEQ ID NO: 5306 - RNA, 62 nt, Human
gagagauuagaagacaacaggcauagcaaaugacauaagcuaccgauuaacuaaucggaaca

SEQ ID NO: 5307 - RNA, 62 nt, Human
gagagcaacuauuuggagugcacagccuauugaacuaccucauuuuugccaauaagagcugg

SEQ ID NO: 5308 - RNA, 62 nt, Human
gagagcaauaagaacaaauuuauuuugcuuaccacaguguuauagcugguucuagaaauuug

SEQ ID NO: 5309 - RNA, 62 nt, Human
gagaggaaagaacacuucccaacuuacucuaggucaguauuacccugauacuagacuagaca

SEQ ID NO: 5310 - RNA, 62 nt, Human
gagaggaugggucugugcugaaggcccaacaggaucaucucauugcaugauuuucuuuacuu

SEQ ID NO: 5311 - RNA, 62 nt, Human
gagagggaggacagagcccuucagaacagaggccucaucucacugcaucccccaucaccccc

SEQ ID NO: 5312 - RNA, 62 nt, Human
gagagguggggacagcaagaagccacagauuggcaugaaggauccugaccugacuauccaug

SEQ ID NO: 5313 - RNA, 63 nt, Human
gagagugagcgggguacaguaaggcagugcuucccacacuggaccucuuuccugguucucuuu

SEQ ID NO: 5314 - RNA, 64 nt, Human
gagaguuuuccuguucagauuacccugcccagcaggaacuggaauacaguguucggggagaagg

SEQ ID NO: 5315 - RNA, 62 nt, Human
gagauacagaggauguggcagagaugaucaguggucaucucagaauggucucugaaccagca

SEQ ID NO: 5316 - RNA, 62 nt, Human
gagauggaguuucacucuuguugcccaggcuggagugcaauagcaugaucucggcucacugc

SEQ ID NO: 5317 - RNA, 62 nt, Human
gagauggaguuucacucuuguugcccaggcuggagugcaauagcucgaucucggcucacugc

SEQ ID NO: 5318 - RNA, 62 nt, Human
gagauggaguuuugcucuuguugcccaggcuggagugcaauagcgcgaucuuggcucaccgc

SEQ ID NO: 5319 - RNA, 61 nt, Human
gagaugugagaugacaacaggaacauacaagauacugugaaucuagauguucugaccuaaa

SEQ ID NO: 5320 - RNA, 62 nt, Human
gagauuccuguuugggauuuaauauccagggcuguguuuacaguaaaaaaagcaggcagucc

SEQ ID NO: 5321 - RNA, 62 nt, Human
gagauuuagaaucuggaccaggcuguggguagaugugcaauagaaauagcuaauuuauuucc

SEQ ID NO: 5322 - RNA, 62 nt, Human
gagauuuauggaaguugaauaccuaagcaggaauugcugcuagcuccaaaaauuugcgaagc

SEQ ID NO: 5323 - RNA, 63 nt, Human
gagcaacagcagcucccauuucuagaacacauuuacaguauuacuauuuucuaggauauaaag

SEQ ID NO: 5324 - RNA, 61 nt, Human
gagcaaguuuaagucuggcugaauccugaggccacugugaauuugcugauguucuuccaac

SEQ ID NO: 5325 - RNA, 62 nt, Human
gagcaccgagaaccaucugugagcugccgcugugaugaaggagccugcucugaggaacagac

SEQ ID NO: 5326 - RNA, 63 nt, Human
gagcagaaucuccgugggacaucuuucuggagcaucaguauuacugcaggauuuggaagaaac

SEQ ID NO: 5327 - RNA, 64 nt, Human
gagcagcaccgaggucggagcugugaggacuuccagaacuggaaacgcaugaacgacccagaau

SEQ ID NO: 5328 - RNA, 61 nt, Human
gagcagcagacuaugggcagcccagugcugccaccugcugacgacccuugagaagcugcca

SEQ ID NO: 5329 - RNA, 63 nt, Human
gagccacugcacccggcuugaaucauccuuuuguccaguauuauauccaugcuguauaugcua

SEQ ID NO: 5330 - RNA, 62 nt, Human
gagccacuguggcaucugaggaagacccaggguacaguauuagcauuucuuucaacccuaag

SEQ ID NO: 5331 - RNA, 62 nt, Human
gagccccgcuucuucccacuccacuuguugucccaugaaggaagaagugggguuccuccuga

SEQ ID NO: 5332 - RNA, 62 nt, Human
gagccuguuucucauuuguaaauggugauaauaccuaccucauaggguuguugugaggauua

SEQ ID NO: 5333 - RNA, 62 nt, Human
gagccuugucuguaucugggcagcagguguuccaugcugcuagguggcgggggucggggguc

SEQ ID NO: 5334 - RNA, 63 nt, Human
gagccuuguguuucuuuccugcagacgugagaugaacacuggagugggcagagguggcccagg

SEQ ID NO: 5335 - RNA, 64 nt, Human
gagcgcaugaggugacagaggcagagaugcugcugcaacuggaagaagcuggaaccagucccag

SEQ ID NO: 5336 - RNA, 62 nt, Human
gagcgccucucacacagguaaugcccagcuuuucugcugcuaacacauuuggccaguuguug

SEQ ID NO: 5337 - RNA, 62 nt, Human
gagcggggagccaggaaagaagaguuggagugagaugaaggaaggacuaugacaaauaaaaa

SEQ ID NO: 5338 - RNA, 62 nt, Human
gagcuaagagaauugggcauuaguauuucauuaugugcaauaagucauuguaagugcacuga

SEQ ID NO: 5339 - RNA, 62 nt, Human
gagcugagaaugguaaggagacucuucuaagucuucaucucagagacccugaguucccacuc

SEQ ID NO: 5340 - RNA, 62 nt, Human
gagcugagaguuuacaggcacugcagaagcuguucaguauuauauguguauaugcuauuuuu

SEQ ID NO: 5341 - RNA, 64 nt, Human
gagcugaugugagugugugugaugggaucuguaaggaacuggaacacacauguccuauccaaag

SEQ ID NO: 5342 - RNA, 61 nt, Human
gagcugccugguguccacgggggagggccaaggccugcugagcugauucuccagcugcugc

SEQ ID NO: 5343 - RNA, 63 nt, Human
gagcuggcaauugaacaucauucaucuaaauaugcacacuggaggcaagaugagaauuccuga

SEQ ID NO: 5344 - RNA, 63 nt, Human
gagcugguagaacccccugcaaccgcugcugcaagacacuggacagacccagcuuucgggacc

SEQ ID NO: 5345 - RNA, 61 nt, Human
gaggaaucgaggaaccagagccauggacucuacacugugaacuuggggaacaaggguggca

SEQ ID NO: 5346 - RNA, 62 nt, Human
gaggacccagggaguuuggauguggaaguaaaagugcugcuaaaaccuggcuuggugggagc

SEQ ID NO: 5347 - RNA, 61 nt, Human
gaggacccugagugccagauuccccuggacgcuccugcugauucugucggcaguugaaggc

SEQ ID NO: 5348 - RNA, 62 nt, Human
gaggagaaaugagagggcuuaaaugaaauuuaaaauaagcuauauuauacaaauacuaucuc

SEQ ID NO: 5349 - RNA, 62 nt, Human
gaggagcaaggacaucuguggaaagauguaacuucaguguuaaaaauuuuuuauucaguuau

SEQ ID NO: 5350 - RNA, 62 nt, Human
gaggaggacgaacagagauccugaaauucugacuugcugcuauuccagaacccagccuccug

SEQ ID NO: 5351 - RNA, 62 nt, Human
gaggaguagcccccuuuuucagagaguuuggggucuaccucagagcucucccugucaaaaag

SEQ ID NO: 5352 - RNA, 62 nt, Human
gaggaugugugaaaagcucacagagcccgaugccugcugcuauuucacggcaaugagccuuu

SEQ ID NO: 5353 - RNA, 63 nt, Human
gaggcacggggagagggaggaugagacaauuuaggacacuggacaugaguuuuucagauggcc

SEQ ID NO: 5354 - RNA, 61 nt, Human
gaggccccacagggagcagagacugcuuuaaucccugcugacaucacggaaaagcaacaga

SEQ ID NO: 5355 - RNA, 61 nt, Human
gaggcccugaaacuacguagagagggagaggcaccugcugaacccugucuucuugacaucc

SEQ ID NO: 5356 - RNA, 61 nt, Human
gaggccuguuccucacaggcuuccagguuaggcacugugaauaggcucagcuccucuagag

SEQ ID NO: 5357 - RNA, 64 nt, Human
gaggcuccaauaccugggaauguucacaaagucaucaacuggaaaaaaagcaaaaacccacggc

SEQ ID NO: 5358 - RNA, 62 nt, Human
gaggcuuagaauuucaaccacgugucaggucagacaguauuauaaacuguacuuugcugucu

SEQ ID NO: 5359 - RNA, 62 nt, Human
gaggcuucugaagguugcugucugucaugagugcaugaaggaggccaagaguuuaugcuaug

SEQ ID NO: 5360 - RNA, 62 nt, Human
gagggagcauggcaaagucgguuucucucuggacuguuuacacuucaaggcgguggauuuag

SEQ ID NO: 5361 - RNA, 62 nt, Human
gagggagggcagcguccuuuaaaaauaccaaaaauguuuacagaguugggugcugagcugca

SEQ ID NO: 5362 - RNA, 62 nt, Human
gagggagguggaggagcugggcugcuuuucccagcaguauuagugucccccaggacagggga

SEQ ID NO: 5363 - RNA, 64 nt, Human
gagggcagaagauuaagggaggggaagagucccuggaacuggaagaagguaaauacuuugccuu

SEQ ID NO: 5364 - RNA, 62 nt, Human
gagggcugcaccucccacgguggucaccaugccaaugaaggaaguucagucuugucuuugau

SEQ ID NO: 5365 - RNA, 63 nt, Human
gaggggguugcuggagcgacggagaacguggaacuacacuggaggacaccagaguacucuuaa

SEQ ID NO: 5366 - RNA, 62 nt, Human
gagguacaccagagauugcucagugugcagccugcuaccucacuuuuggcucuggauugccu

SEQ ID NO: 5367 - RNA, 61 nt, Human
gaggucaccacuauuuggggaacaagcuugcguccugcugaggggcaggauuuucagcaga

SEQ ID NO: 5368 - RNA, 61 nt, Human
gagguggauguguuuuccuuguguuggauggcaugagauuaugugaauguuuugauuuauu

SEQ ID NO: 5369 - RNA, 61 nt, Human
gaggugugugggcccuuuuguucaccucugcagacugugaauccuagcugccaguuugccu

SEQ ID NO: 5370 - RNA, 64 nt, Human
gagguuuuuaguuauauaugcuauauauauauauauaacuggaaauguuuuauauguuuuccga

SEQ ID NO: 5371 - RNA, 62 nt, Human
gaguaaauauacacauaaauguuuggggauucauugcugcuagauuauaucagguguuuaca

SEQ ID NO: 5372 - RNA, 63 nt, Human
gaguaacuugcaaguuuucaguacaaaucugugcuacacuggauaaaaaucuaauuuaugaau

SEQ ID NO: 5373 - RNA, 62 nt, Human
gaguacugaaauguuuuguaaauuuuuuuuaaugugcugcuagguuuuuuguuuuguuuugu

SEQ ID NO: 5374 - RNA, 62 nt, Human
gaguaggguuaagguucucagugacacaagaauucaguauuaaguacauagguauuuacuau

SEQ ID NO: 5375 - RNA, 64 nt, Human
gaguauaccuuguaaaucuucccaaauguuguggaaaacuggaauauuaagaaaaugagaaauu

SEQ ID NO: 5376 - RNA, 64 nt, Human
gaguauuuuaaacacuagaccccaggagcuuggcugaacuggaaagagaacauacaaagcucug

SEQ ID NO: 5377 - RNA, 62 nt, Human
gaguauuuucaagaaaagaauaaaaacauuaaugcaguauuagguuaacuggauaucaacua

SEQ ID NO: 5378 - RNA, 63 nt, Human
gagucaaacaguuggaaacagcacauugcugauuuacacuggaucuugccuuagaaaccauug

SEQ ID NO: 5379 - RNA, 61 nt, Human
gaguccaccaugacggaugaggcaccuccuuucccugcugaaggacaaaccuuguuucccu

SEQ ID NO: 5380 - RNA, 61 nt, Human
gaguccguagagaccugcgcaggagccgggaccccugcugagcagugggagcuuucuguca

SEQ ID NO: 5381 - RNA, 62 nt, Human
gagucucucagccuuugcuuacugguguuuccgacaguauuaacccagugcguggcaugucu

SEQ ID NO: 5382 - RNA, 61 nt, Human
gagugacccaaggcucaauggaugagcagggucccugcugaggacuucucuugaguacaau

SEQ ID NO: 5383 - RNA, 61 nt, Human
gagugagguggccugaaugacaccucuuagaggacugugaaguacaggcacagcccgacug

SEQ ID NO: 5384 - RNA, 63 nt, Human
gagugauucacaccuggaacaacauacuggacuucacacuggagagaaaccuuacaaguguaa

SEQ ID NO: 5385 - RNA, 63 nt, Human
gagugauucacaccuggcacaccauacuagaauucacacuggagagaaaccuuacaagugcaa

SEQ ID NO: 5386 - RNA, 64 nt, Human
gagugggaguggaggagggcagaggacacgucucagggccaguaaccuaggcuuauagaagacg

SEQ ID NO: 5387 - RNA, 61 nt, Human
gaguggguguccccugugugucagugggcagcuccugcugaacccgcagcucacuagggag

SEQ ID NO: 5388 - RNA, 61 nt, Human
gaguggguguccccugugugucagugggcagcuccugcugagcccgcagcucacuggggag

SEQ ID NO: 5389 - RNA, 61 nt, Human
gagugguuaugauaccaaaaaauguagcuggguugagauuaauuucguucuguuuucucau

SEQ ID NO: 5390 - RNA, 62 nt, Human
gagugugcagccugcaucaccugcuguaugccgaucaucucagaaagggcuguguagaguag

SEQ ID NO: 5391 - RNA, 62 nt, Human
gaguucguucugacucuuucucauucugaguuuucaguguuaaacuaggaagugugacagca

SEQ ID NO: 5392 - RNA, 63 nt, Human
gauaaaaauuacacuuuuuuuuuugguuuauuccccaguauuaaaaacaaagcaagcugaguc

SEQ ID NO: 5393 - RNA, 62 nt, Human
gauaaacuugcaagauaagacaacuuuaagaaaccaguguuaauaacaauauuaacagggau

SEQ ID NO: 5394 - RNA, 64 nt, Human
gauaacaaucuuucaagucguagcacuuuguuucagaacuggaauggagauguagcacucaugu

SEQ ID NO: 5395 - RNA, 61 nt, Human
gauaaccuugugguuaaaagauaaggaaaaauaugagauuaugagaaauuaaauguauacu

SEQ ID NO: 5396 - RNA, 62 nt, Human
gauaaguguuuguguucagaagauguuguuuugccaguauuagaaaauacugugagccgggc

SEQ ID NO: 5397 - RNA, 62 nt, Human
gauacaguaaauuuuuagaaaaaaauaccauuuacaguauuauugugaaccauuuaacccuu

SEQ ID NO: 5398 - RNA, 64 nt, Human
gauacccaauuucauuuuauccuuuuuguauugugaaacuggaaacuuuaugacauuguaaauu

SEQ ID NO: 5399 - RNA, 62 nt, Human
gauacccuuauuggaaucaaggcagugcuguuucuguuuacaaguuaucaagauaagagcag

SEQ ID NO: 5400 - RNA, 63 nt, Human
gauaccucugugauucacgcugagcccaaguccccacacuggaaaacugggaaauggccagcu

SEQ ID NO: 5401 - RNA, 62 nt, Human
gauacguuuuuuaaauuucuauuuucacauugaucaguguuacuuugcuuaauacuuaggua

SEQ ID NO: 5402 - RNA, 64 nt, Human
gauacucagacaacucacagaaacaacuucuguaauaacuggaaauacugcuguuaucguuuag

SEQ ID NO: 5403 - RNA, 63 nt, Human
gauacugcuuuaacuacuguugacaaccaaguagagugacuuaagcugaacaguaacuaacug

SEQ ID NO: 5404 - RNA, 62 nt, Human
gauagaagagugggcuuuaacuggcaggccuguauguuuacagacuaccauacuguaaauau

SEQ ID NO: 5405 - RNA, 62 nt, Human
gauagauacacugcaucuuuggucaucuaagauuuguuuacaaaugugcaaauuauuuagag

SEQ ID NO: 5406 - RNA, 61 nt, Human
gauagcuuauuauuuucauaaguaaaaaacaaaugagauuauauauauauauauaaaaaua

SEQ ID NO: 5407 - RNA, 62 nt, Human
gauaguaauucuuaaagugccaucuaucccagauuuccguuauagaccagcauauguguaau

SEQ ID NO: 5408 - RNA, 62 nt, Human
gauauaauaaaagguguuuaucauaaaaaagaaacaguauuagauuuuggucuccauaaucu

SEQ ID NO: 5409 - RNA, 62 nt, Human
gauauagagaaaucuggcuggcuacaguguagaucaguauuaggaauauuucuaaagauccu

SEQ ID NO: 5410 - RNA, 54 nt, Human
gauauguucccaguuguagaaauuacuguuuacacacauuuuuguucaauauug

SEQ ID NO: 5411 - RNA, 61 nt, Human
gauauuuaaagaucuuugcuugcagcccuccguccugcugaaaacccccauaagccaguga

SEQ ID NO: 5412 - RNA, 63 nt, Human
gauauuuaauccuuaaaaccccuuuaaaugagggccaguauuaucucugcuuucagaaguaga

SEQ ID NO: 5413 - RNA, 61 nt, Human
gauauuugaaacuuaccuuguuuucacuugugcacugugaaugaacuuuguauuauuuuuu

SEQ ID NO: 5414 - RNA, 64 nt, Human
gauauuuuacauccuuuuuuguaccaagucuucuaaaugcaguacauauuuuauacuuacugca

SEQ ID NO: 5415 - RNA, 64 nt, Human
gaucacuguuguuuuuugaagugccaaucccaugccaugcaguauuaugucccucuccuaucug

SEQ ID NO: 5416 - RNA, 57 nt, Human
gaucagccagccuaacugaaagaugauguaugaaggaguuggaguuguugaaaccaa

SEQ ID NO: 5417 - RNA, 63 nt, Human
gaucauauaugucuuaguggacaggggucugaaguacacuggaauuuacugagaaacuuguuu

SEQ ID NO: 5418 - RNA, 62 nt, Human
gauccaccacaccccaccgagcacuagaagcugcauaagcuacacaggaugugcuucugcag

SEQ ID NO: 5419 - RNA, 64 nt, Human
gauccacucccauggauccacucacaugcugcaggcaugcaguagacucacccacagcccacuc

SEQ ID NO: 5420 - RNA, 61 nt, Human
gauccagagacauagaggaaguagggggugguaugagauuauauuuucuguuuuuaaaaga

SEQ ID NO: 5421 - RNA, 62 nt, Human
gaucccauuuagccccugaacauaauaccaucugcaguauuauaaaagucauuuagaagguc

SEQ ID NO: 5422 - RNA, 62 nt, Human
gauccuccauggcaguuagugaauguaagaaguacaguguuaaaguguuguaaacaguuacu

SEQ ID NO: 5423 - RNA, 62 nt, Human
gauccuucacaggcagugcaugugaagcaugcuuugcugcuaugaaaaugagcaucagagag

SEQ ID NO: 5424 - RNA, 62 nt, Human
gauccuuuggauugccucaauguucuuacucaagucaucucacuuauaaggagaguuauagg

SEQ ID NO: 5425 - RNA, 62 nt, Human
gaucuauugaauuucagagaagagccuucuaacuuguuuacacaaaaacgaguaugauuuag

SEQ ID NO: 5426 - RNA, 62 nt, Human
gaucuguguuauucuuaguacccacugauaaauugugcaauaaauaaucuuucgcaagugau

SEQ ID NO: 5427 - RNA, 62 nt, Human
gaugaaaugaggagauaaacuaaacauuaaaaugaugaaggaaaaaaaauuauuuggaagcc

SEQ ID NO: 5428 - RNA, 62 nt, Human
gaugaacuggugcagugccugacagaauaaagaacaguauuaaucccuuugagaaagcauag

SEQ ID NO: 5429 - RNA, 62 nt, Human
gaugaagaaagaaaagcaggggugcuuuuggaagcaguguuaguguuccucaaaagucggaa

SEQ ID NO: 5430 - RNA, 64 nt, Human
gaugaagguaaggguccguucuacuuggcuugggacaacuggaagucagccacaaaggaauggc

SEQ ID NO: 5431 - RNA, 64 nt, Human
gaugaauuauaaggaaauaaacagacccaauucaucaacuggaaagcaauucuaugcuggugcu

SEQ ID NO: 5432 - RNA, 62 nt, Human
gaugaauuuuucaucagaagugcuuacaggguuacuaccucaguuuacaaucuaccugguca

SEQ ID NO: 5433 - RNA, 63 nt, Human
gaugacuaccgugaggauggauuggacauuacaccacacuggaaaagugaaacaucucauuca

SEQ ID NO: 5434 - RNA, 62 nt, Human
gaugagaaguaaauuacggguuaugagaaauguuaugaaggaaaggacaacaacagacaugu

SEQ ID NO: 5435 - RNA, 62 nt, Human
gaugagcuacgccuugaugaaagaaccguguuggugcugcuaaguuuagccauuaugguuuu

SEQ ID NO: 5436 - RNA, 61 nt, Human
gaugauuaaauauauccaagagacauuggaaaaccugcugaacauuuuacauuggucugcu

SEQ ID NO: 5437 - RNA, 61 nt, Human
gaugauuugcucuauaguagaauauuuaaguagacugugaaauauuuauuaauauagaugu

SEQ ID NO: 5438 - RNA, 62 nt, Human
gaugcaggagaugcuacacaaaauacaaaaacagaugaaggagaacuauuaacuggcuuuca

SEQ ID NO: 5439 - RNA, 64 nt, Human
gaugccaaacauguucccccuucuucacuuccuuggaacuggaaguauuauuccuaagucuagu

SEQ ID NO: 5440 - RNA, 61 nt, Human
gaugccauucuccauggcacuauuccuucaucuacugugaagugaaguuggcgcagcccug

SEQ ID NO: 5441 - RNA, 61 nt, Human
gaugccgcggggugggggcugccuguaaaugacacugugaauaaacccguuaccuuacuuc

SEQ ID NO: 5442 - RNA, 62 nt, Human
gaugccugucuugaguagacuuggacccaaaaaaucaucucaccuugagcccacccccaccc

SEQ ID NO: 5443 - RNA, 62 nt, Human
gauggaauguuaccuguccguguuacauaaucaagugcaauauacucaguucucaugcaggu

SEQ ID NO: 5444 - RNA, 62 nt, Human
gauggcagaacgaugccugcaggcauggaacuuuuuccguuaucacccaggccugauucacu

SEQ ID NO: 5445 - RNA, 61 nt, Human
gaugggagaacuugagggugaucgggaaccuccccugcugaggguggugucaggguuccgu

SEQ ID NO: 5446 - RNA, 61 nt, Human
gaugggagcccuggagugggcaagaccaggccaccugcugaggucgcuguggagcacccuc

SEQ ID NO: 5447 - RNA, 61 nt, Human
gaugggauaggaaauuaugauuaugauguuaaaacugugaaaaguagaaaaccacauggau

SEQ ID NO: 5448 - RNA, 63 nt, Human
gaugggccugugcauccuggccaagcgucacccucacacuggaggaggaugucugcucuggac

SEQ ID NO: 5449 - RNA, 62 nt, Human
gaugggggcaaggauacaucagagaauuccugccucaucucacgcucacuccaagguagaga

SEQ ID NO: 5450 - RNA, 63 nt, Human
gauguaauguaguucuuuguuccugcuuucucuuucaguauuaaacucuccuuugauauuaug

SEQ ID NO: 5451 - RNA, 62 nt, Human
gauguacaguauuuuuuguuguuuuuaucaucaugugcaauauuacugauuuguuuccaugc

SEQ ID NO: 5452 - RNA, 62 nt, Human
gaugucugggccuucggugugcugaugugggaaguguuuacacauggagagaugccccaugg

SEQ ID NO: 5453 - RNA, 62 nt, Human
gauguggugacucaugugaaguggugucauaggaaugaaggacugugggcgcuggguucaaa

SEQ ID NO: 5454 - RNA, 63 nt, Human
gauguucaugucuaucucaaccaggaccagacccugugacuuacucgguaauaacaguccaca

SEQ ID NO: 5455 - RNA, 64 nt, Human
gauguuggccucauacucuauacucagggcuuaaugaacuggaaucugcauaacucagcaguca

SEQ ID NO: 5456 - RNA, 61 nt, Human
gauguuguacuuccaucaugcaaaaaaaaagcuccugcugaaacuccugugaaagaaagac

SEQ ID NO: 5457 - RNA, 62 nt, Human
gauguuguuaugaucgccuguggauuuuguccauucaucucaugcucucugaacagaaggua

SEQ ID NO: 5458 - RNA, 62 nt, Human
gauguuuguguaugugggaguacucucaucacuacaguauuacucuuacaagaguggacuca

SEQ ID NO: 5459 - RNA, 62 nt, Human
gauuaauuucuaacauugcagcaguuucauaugugugcaauaugugcauucuuucauuuuag

SEQ ID NO: 5460 - RNA, 62 nt, Human
gauuauaagccuaaugguguggagguuuugaugguguuuacaacacacugagaccuguuguu

SEQ ID NO: 5461 - RNA, 62 nt, Human
gauuaugaugacuaugcggacuucuauauugucuucaucucauuguguguauuauguauuua

SEQ ID NO: 5462 - RNA, 62 nt, Human
gauucacuuuccccccacccuaacuugagauaaaaugaaggacuaggcaaguauuucauguu

SEQ ID NO: 5463 - RNA, 62 nt, Human
gauucacuuuguguguguuagugcucuaaaguagcaguauuauuauuaaacuguccccagag

SEQ ID NO: 5464 - RNA, 61 nt, Human
gauucaugcuaccuaaaaauuaacagaaaugacacugugaacaauguaguuggaaaauagg

SEQ ID NO: 5465 - RNA, 63 nt, Human
gauucugcagcaccggccucgggaagccccauccaacacuggauggucaucucggaguuccag

SEQ ID NO: 5466 - RNA, 61 nt, Human
gauugaacccgggaggcagagguugcacugagcugagauuaagccaccgcacuccagccug

SEQ ID NO: 5467 - RNA, 62 nt, Human
gauugaauguagacagggauaugcguauaguuuucaguauuaguucuagauaacacuaaauu

SEQ ID NO: 5468 - RNA, 62 nt, Human
gauugaccucuacagacucagaagaugaugcuaacaguguuaguuuuauuuuuguacugcaa

SEQ ID NO: 5469 - RNA, 62 nt, Human
gauugauauuuuguguauugaacaggaagacugccaguauuaaaaaaauccuucugggaauc

SEQ ID NO: 5470 - RNA, 63 nt, Human
gauugccaaggaaaccuccucauugggcuaaggagacacuggagucuggaguguggagcccca

SEQ ID NO: 5471 - RNA, 62 nt, Human
gauuggauuuuauguugacauuuguuugguuauagugcaauauauuuuguaugcaagcaguu

SEQ ID NO: 5472 - RNA, 62 nt, Human
gauugucaggggaaaaacuuacaaaaugcuacaguguuuacaaaugccaguuccaggugauu

SEQ ID NO: 5473 - RNA, 61 nt, Human
gauugugugccuugcaauaaaaucaaaacuguaccugcugaaaaucacaacagucagucgu

SEQ ID NO: 5474 - RNA, 61 nt, Human
gauuguuucuagagucacaaugaauuauuuuuaugagauuaccuuauuuuuauauaugaca

SEQ ID NO: 5475 - RNA, 63 nt, Human
gauuuauauugugaacuaaacuaagccuacuuuuugugacuuauuugugaugccuuguugaua

SEQ ID NO: 5476 - RNA, 61 nt, Human
gauuuaucaugagcuuauaucaccaguuuauuuacugugaaaaaaaccaugggaauggcau

SEQ ID NO: 5477 - RNA, 61 nt, Human
gauuuauuugaaaaccagcuguaaguugugcauugagauuauguuaaaagccuuggcuuaa

SEQ ID NO: 5478 - RNA, 62 nt, Human
gauuucaaggggaagggagucgucugccauucaauguuuacauuuauguucugcaagacgcu

SEQ ID NO: 5479 - RNA, 64 nt, Human
gauuucaaguuauaugaugaaauucugaauuaaugaaacuggaaaacuuuauagaauuacuuau

SEQ ID NO: 5480 - RNA, 62 nt, Human
gauuuccuuccuguauuauacauauaauggaauguuccguuacaugugcguaccacacucug

SEQ ID NO: 5481 - RNA, 61 nt, Human
gauuucuuucuuauagucauuauuaguagcagaugagauuaauaauucacauguuuauuaa

SEQ ID NO: 5482 - RNA, 61 nt, Human
gauuucuuuuuugaaguuuuuucuuguaacaucugagauuagaaguuuaagaugacuugac

SEQ ID NO: 5483 - RNA, 64 nt, Human
gauuugcaaugcaaggucuccuugaccccuugccacaacuggaaacacuugaaaggggacccca

SEQ ID NO: 5484 - RNA, 62 nt, Human
gauuuuaaugaaggcucuuuucagauguaaccuuaugaaggaaauaucugcuuuguguauau

SEQ ID NO: 5485 - RNA, 64 nt, Human
gauuuuauuuaauacaaucggauuuaauaauuuuguggccaguaaaauuauaccauuggcauga

SEQ ID NO: 5486 - RNA, 62 nt, Human
gauuuuauuugacaaaauuuguugaaauuauguauguuuacauaucaccucauggccuauua

SEQ ID NO: 5487 - RNA, 64 nt, Human
gauuuuuaggaagcuauugccuaaaucagcgucaacaugcaguaaagguugucuucaacugguc

SEQ ID NO: 5488 - RNA, 62 nt, Human
gauuuuuauuuuguuauaauuuaguuaccauuuucaguguuauuucaaagguucuuugaaga

SEQ ID NO: 5489 - RNA, 62 nt, Human
gauuuuuugcuuguuuguuuguuuuguacuaaaacaguauuaucuuuugaauaucguaggga

SEQ ID NO: 5490 - RNA, 63 nt, Human
gauuuuuuucuauagugaacucugugggcgucucccaguauuacccuggaugauaggaauuga

SEQ ID NO: 5491 - RNA, 62 nt, Human
gcaaaagaagacaaaagccccccaggauguagaaaugaaggaccuugaagaugagagcuaaa

SEQ ID NO: 5492 - RNA, 62 nt, Human
gcaaaagagaaaaagaaggauugaucagagcauugugcaauacaguuucauuaacuccuucc

SEQ ID NO: 5493 - RNA, 64 nt, Human
gcaaaaguccugcaugccucaacuuucucauccuaaaacuggaaacuuauuucucauuuagaaa

SEQ ID NO: 5494 - RNA, 63 nt, Human
gcaaaaucuagggguguaaguguaucaggacuuaugugacuuauauuuuggggagaugagggu

SEQ ID NO: 5495 - RNA, 61 nt, Human
gcaaacaaaguggcaguggggaccaggguguccccugcugagaaauggagagcucuuuucc

SEQ ID NO: 5496 - RNA, 62 nt, Human
gcaaaccucugucucccgaguucacgugauucuccuaccucagccucccgaguagcugggac

SEQ ID NO: 5497 - RNA, 62 nt, Human
gcaaacucuuacugccuuucuccugguuucaugacaguguuauuccuuuuucuauaaauaua

SEQ ID NO: 5498 - RNA, 62 nt, Human
gcaaagaucagagcaggugagcauccacuuugacaugaaggacaagaagacgcauggcucau

SEQ ID NO: 5499 - RNA, 62 nt, Human
gcaaaggacuuaaaauuaccaaaugcuucuaaauaugaaggagagguuggggacacgcaccc

SEQ ID NO: 5500 - RNA, 62 nt, Human
gcaaauaauuuuuaaagaaaagccuauaauuacaucaucucaauaaauuuuuuauggaacca

SEQ ID NO: 5501 - RNA, 63 nt, Human
gcaaauucaauauuauucauaagcauguaauuccagugacuuacuaugugagaugacuacuaa

SEQ ID NO: 5502 - RNA, 62 nt, Human
gcaacagauuuugccuccccgaucagugugugccuguuuacagcacuaucuaucuuucucuc

SEQ ID NO: 5503 - RNA, 64 nt, Human
gcaacagcagucauacccaaaucauuugcacuuuaaaacuggaagauuaagcuuuuguuaacac

SEQ ID NO: 5504 - RNA, 62 nt, Human
gcaaccuggcuuuuauucauccucagccggcaacucaucucaaguuuaugucucaguuuuuu

SEQ ID NO: 5505 - RNA, 61 nt, Human
gcaacugcaggggaggccacugugcccuucaucacugugaacgggucugaguuccuggaaa

SEQ ID NO: 5506 - RNA, 61 nt, Human
gcaagcuugaagccccuuggcuuacagcauuugccugcugaauacuaaacacucacauggc

SEQ ID NO: 5507 - RNA, 62 nt, Human
gcaaggggcagcacugccugcugcuuccuuccccuguuuacagcaauaagcacguccuccuc

SEQ ID NO: 5508 - RNA, 64 nt, Human
gcaaggucugcuaucaggaguuacuguaaaaacaagaacuggaagcucguguuuccgguacugg

SEQ ID NO: 5509 - RNA, 62 nt, Human
gcaaucaauuauacccaccaacaccacugaaaucauaagcuauucacgacucaaaauauucu

SEQ ID NO: 5510 - RNA, 62 nt, Human
gcaauccccaaccucugacugcaaugaccuuucugugcaauaaaagcuuauuguccauuucu

SEQ ID NO: 5511 - RNA, 61 nt, Human
gcaaugccuguggcuucagucaauugucuugagacugugaagaggcugaaagacaccuucc

SEQ ID NO: 5512 - RNA, 61 nt, Human
gcaauuuucuaaauaauuucauuacuaauaugaacugugaaguugucauuuuuucauuugu

SEQ ID NO: 5513 - RNA, 64 nt, Human
gcacaacauaugcaauuauauuuauugaauuccuagaugcaguauggauauuuaaauuguuaaa

SEQ ID NO: 5514 - RNA, 64 nt, Human
gcacaauuuuggacucuggcgccaaacugagucauaggccaguagcauuacguguaucuggugc

SEQ ID NO: 5515 - RNA, 61 nt, Human
gcacaccuggauggcuuugcaccugguguugaaccugcugaagcagguggaugcucaagau

SEQ ID NO: 5516 - RNA, 62 nt, Human
gcacagcugugaggcgaugcuguuccaucugcacaugaaggacccccauacagccugucucc

SEQ ID NO: 5517 - RNA, 63 nt, Human
gcacauccacgcuguauacgccacccacccugcuagugacuuaguagccgucuuggugaucag

SEQ ID NO: 5518 - RNA, 62 nt, Human
gcacauuuuaucuauuuauuuaguuccauucaccaugaaggaagaggcacugagauccauca

SEQ ID NO: 5519 - RNA, 63 nt, Human
gcacccagccucccuucuccuuccacucccuuaguacacuggagugccgagcccugccuucca

SEQ ID NO: 5520 - RNA, 62 nt, Human
gcaccccugcccccugguucaccagagggagcggaugaaggauggcagcaucucacaugccc

SEQ ID NO: 5521 - RNA, 61 nt, Human
gcaccucucuucugcacagcuccuccccugcuaccugcugagccagauuccccaggaaucu

SEQ ID NO: 5522 - RNA, 62 nt, Human
gcaccuggcuccuaccuggaggacucaguuguucuguuuacauccugguggcaccucucacc

SEQ ID NO: 5523 - RNA, 64 nt, Human
gcacgagggcacacugcuaguaaauaacauuaaaauaacuggaaugaacuccugaucccaaagc

SEQ ID NO: 5524 - RNA, 61 nt, Human
gcacgguggcucacgccuguaaucccagcgugcugagauuacaggugugagccacccugcc

SEQ ID NO: 5525 - RNA, 63 nt, Human
gcacguauuuugcaaaagcuacuuuuccuaguuuucaguauuacuuucauguuuuaaaaaucc

SEQ ID NO: 5526 - RNA, 63 nt, Human
gcacguuucauggacuguuaccaacaaagaaaagucaguauuauguuguucucagacacuuug

SEQ ID NO: 5527 - RNA, 62 nt, Human
gcacuagacuuuucuauuggccugugccaucgcccaguauuagcacaaguuagggaggaaga

SEQ ID NO: 5528 - RNA, 63 nt, Human
gcacugaaaaaggacuucugcauuucugacauagaacacuggaaucccagugaggaauucuaa

SEQ ID NO: 5529 - RNA, 61 nt, Human
gcacugcuaagcuuuucaagguaucuuuccaauccugcugauguggcagucaauggcugca

SEQ ID NO: 5530 - RNA, 64 nt, Human
gcacugcugguggccaggagugcggucuacuuggggaacuggaauggagagacccagguacuaa

SEQ ID NO: 5531 - RNA, 62 nt, Human
gcacuguuggauucuggguaugacauacucgcagcaguguuacuggaacuauuaaguuugua

SEQ ID NO: 5532 - RNA, 61 nt, Human
gcacuucccauguacgugccaaggguaagcuggccugcugagcccagggcgacagaggggc

SEQ ID NO: 5533 - RNA, 61 nt, Human
gcacuuggcagccucaugauccuuuuauaaaugugagauuaacaggagagcagcaauacga

SEQ ID NO: 5534 - RNA, 62 nt, Human
gcacuuuuuaugcucccacugugguugagcuuuauguuuacagucucagcaacaacacuuau

SEQ ID NO: 5535 - RNA, 62 nt, Human
gcagaaccuccucagucucaguacucuuguuucuaugaaggaaaaguuuggcuacuaacagu

SEQ ID NO: 5536 - RNA, 62 nt, Human
gcagaauuaacagaccucuucuccucaugguacacaguauuacaguguugaaguaaugguga

SEQ ID NO: 5537 - RNA, 63 nt, Human
gcagagauaacacuucccaacucauuuugugaggccaguauuacccuaauagcaaaaccaggc

SEQ ID NO: 5538 - RNA, 64 nt, Human
gcagaggaaaggccagccaagcuuggggcaagcuugaugcaguaggagagacuccuuaugaggc

SEQ ID NO: 5539 - RNA, 61 nt, Human
gcagaggacagaguuggcuuugcgcggucucugccugcugagcaguuccaauuccucucau

SEQ ID NO: 5540 - RNA, 61 nt, Human
gcagauucuguuccaucuuugcacuguugcuuaccugcugauuuucuuaacuguucuugug

SEQ ID NO: 5541 - RNA, 63 nt, Human
gcagauuuucaccuggguucuggcuccgguguuuaacacuggauacaucuuugaugugcgaaa

SEQ ID NO: 5542 - RNA, 64 nt, Human
gcagcaauuagggagaaaacuagucuaaauuauuucaacuggaaaaaagaaaaaagaguccucu

SEQ ID NO: 5543 - RNA, 62 nt, Human
gcagcagugcuuagagcuucugcagggcuucucuuguuuacacagcugcaucagacaaugcc

SEQ ID NO: 5544 - RNA, 61 nt, Human
gcagcauuugauucucauaggagcacaaacccuacugugaacugcgcaugcaagggaucua

SEQ ID NO: 5545 - RNA, 61 nt, Human
gcagccagaaugaaggugccaucagcaggaggcacugugaagcaccauccugucgcugucc

SEQ ID NO: 5546 - RNA, 62 nt, Human
gcagccuccugauuucauaaccaggccggaccacgugcaauaggguggaaaccaaacugcuc

SEQ ID NO: 5547 - RNA, 62 nt, Human
gcagccucuugaccucggauaacaauaagagagcucaucucauuuuuacuuuugaacguugg

SEQ ID NO: 5548 - RNA, 63 nt, Human
gcagcugucuaggucugcggccacaucuuggggacacacuggacuguucccaugugcaggguu

SEQ ID NO: 5549 - RNA, 63 nt, Human
gcagcuguuguguaaauacuguauauugcaaaaaucaguauuauuuuaagagauguguucuca

SEQ ID NO: 5550 - RNA, 62 nt, Human
gcaggacagcugcuguggggugcagaggcagaagaugaaggacaaaaggaagggaaaacuga

SEQ ID NO: 5551 - RNA, 61 nt, Human
gcaggagggguuuuggaggggaccugcuugcgaccugcugagggcuugucugcucccacag

SEQ ID NO: 5552 - RNA, 63 nt, Human
gcaggccacagccccuggcuuugugcccacuuaggcaguauuaucaacaagguccugcucagu

SEQ ID NO: 5553 - RNA, 62 nt, Human
gcagggauugagccugugaagugauaauuucuaucuaccucauaaaucuuuacauuuccuuc

SEQ ID NO: 5554 - RNA, 62 nt, Human
gcagggcacuccccuguuuccuaagaacgaaaaagugcaauaaaggccauucguuaccuacu

SEQ ID NO: 5555 - RNA, 63 nt, Human
gcagggcugccuccucaccucucuucggccuuuggacacuggagcucagaggaccaagugaau

SEQ ID NO: 5556 - RNA, 62 nt, Human
gcaggugaggcucggcuuggauuauucugcagguucaucucagacccaccuuucagccuuaa

SEQ ID NO: 5557 - RNA, 64 nt, Human
gcagguggauacccgcuuccauggucuugcacuauaaacuggaauggauuucucaaugcgggac

SEQ ID NO: 5558 - RNA, 62 nt, Human
gcaguacucaggaaugcagcacaguacucaggcagugcaauacucagugcgguacucaguaa

SEQ ID NO: 5559 - RNA, 62 nt, Human
gcaguccugaccucccggggcucaggugauccuccuaccucagccucccaagaagcuacgac

SEQ ID NO: 5560 - RNA, 62 nt, Human
gcagugaauguggaagagucuuuaaccaaaauucucaucucauucagcaccagaaaguucac

SEQ ID NO: 5561 - RNA, 62 nt, Human
gcagugcccuggaaggagagggcacagaagcagcuguuuacagaaccuccgagggcugcaau

SEQ ID NO: 5562 - RNA, 62 nt, Human
gcaguguucacaaggauguugguuuggagaugucugcugcuaggaccuggggugugugacuc

SEQ ID NO: 5563 - RNA, 62 nt, Human
gcaguucuacauuaaaucaccuugucaagggcucuguuuacaucuauacauuuugaagauga

SEQ ID NO: 5564 - RNA, 64 nt, Human
gcaguucuuaaaagaagaaaaaaaccacuaacaaauggccaguagaugcuggacacaaucauua

SEQ ID NO: 5565 - RNA, 62 nt, Human
gcauaagcuaucaccuagcagccucaaaacgggucaguauuaagguuuucaaccggaaggag

SEQ ID NO: 5566 - RNA, 62 nt, Human
gcauaagugguuuucuucaggaaaauaaauaucacaguauuaucuguguuaaaaugguuuuu

SEQ ID NO: 5567 - RNA, 62 nt, Human
gcauacaauuuaauguaauuucauuccauucuauuguuuacacaacgauuacucgaagauga

SEQ ID NO: 5568 - RNA, 64 nt, Human
gcauacuuggaacuaaugaaggguauauaauaaaacaacuggaauccaauuugguaagcuaaaa

SEQ ID NO: 5569 - RNA, 62 nt, Human
gcauacuugugaggugccaccucaguagcucauacuaccucacccugcucaggugagcucug

SEQ ID NO: 5570 - RNA, 64 nt, Human
gcauagaaauguuggccuugcagcauuuggugucauaugcaguagccaguggauaaacuaaccu

SEQ ID NO: 5571 - RNA, 62 nt, Human
gcauauauuaaagcaucaggacccuucgugacaauguuuacaaauuacguacuaaggauaca

SEQ ID NO: 5572 - RNA, 62 nt, Human
gcauaucuucaucauauugguauauccuuuucuguguuuacagagaugucucuuauaucuaa

SEQ ID NO: 5573 - RNA, 64 nt, Human
gcauauuuagugaccaaggcaucaaggacaucccgaaacuggaaauucauauccaucugguaug

SEQ ID NO: 5574 - RNA, 62 nt, Human
gcaucaacuaguucuuccauguaaaauaauuuuagugcaauaugaagacguagaaauguaaa

SEQ ID NO: 5575 - RNA, 61 nt, Human
gcaucaucagucuauggacugaaaacauaguucugagauuauaccuuuccgauuuuauguu

SEQ ID NO: 5576 - RNA, 64 nt, Human
gcauccaggccugaggcugcugacguuugacaccagggccaguagagagugcccuuuuguaucu

SEQ ID NO: 5577 - RNA, 62 nt, Human
gcauccgcugggggcgcuguucuuuagcuagugccaguauuaaaacauugucauuacgagag

SEQ ID NO: 5578 - RNA, 64 nt, Human
gcauccuaucgaucuggaaagagcuguuuuggaugaaugcaguauaaaauguaaaaacccugcu

SEQ ID NO: 5579 - RNA, 62 nt, Human
gcauccucuguuccuauucugcccuugcucugugucaucucagucauuugacuuagaaagug

SEQ ID NO: 5580 - RNA, 63 nt, Human
gcaucuaaugucaaaauagaaccaacugguaaucacaguauuauuuagugugguuuccaugac

SEQ ID NO: 5581 - RNA, 62 nt, Human
gcaucuaucauaaagccacacaagccuuauguucucaucucaaaaaugcugugacagcuuuu

SEQ ID NO: 5582 - RNA, 62 nt, Human
gcaucugcuaccugauuuuauccuggagaauacagugcaauauuucucuuugauuauuuauu

SEQ ID NO: 5583 - RNA, 62 nt, Human
gcaugaaaaggauuccuugguuaugugcagggaaucaucucacaugcuguuuuuccuauuug

SEQ ID NO: 5584 - RNA, 64 nt, Human
gcaugaacagcucuuucuuguaugcgauuuaaaacaaacuggaaaggaaacuucacacgucaaa

SEQ ID NO: 5585 - RNA, 61 nt, Human
gcaugacuuggaggggggccuggugccuggggaccugcugaagagaaugcucaccaccagc

SEQ ID NO: 5586 - RNA, 63 nt, Human
gcaugagcuuuucuggcauauguuaugcauguuggcaguauuaaguguauaccaaauaauaca

SEQ ID NO: 5587 - RNA, 63 nt, Human
gcaugcgaggaugaaauaaaccuagaaguggcagaacacuggauuuguguguguggcgcuuua

SEQ ID NO: 5588 - RNA, 64 nt, Human
gcaugcgucaccucacuuaauuuucccagcagccauggccaguaaauguuauuguaucccauuu

SEQ ID NO: 5589 - RNA, 64 nt, Human
gcauguaauauccauauuaguuuuuucuugguagacaacuggaagguuuucuuuuuuuucgucu

SEQ ID NO: 5590 - RNA, 64 nt, Human
gcaugucuaguauauuaagucuccauagcccuccugaugcaguagacagugcuaugcuguggau

SEQ ID NO: 5591 - RNA, 61 nt, Human
gcaugugaugcgagucaagguaguugaugcccaacugugaagggccguucuaaucuagcau

SEQ ID NO: 5592 - RNA, 62 nt, Human
gcaugugugcguaucugaaccaucaucccugcucucaucucagcucccuccaggccugagca

SEQ ID NO: 5593 - RNA, 61 nt, Human
gcauguguggguauuccccagaagcauuugccuccugcugagccuggucccugagcggagu

SEQ ID NO: 5594 - RNA, 62 nt, Human
gcauuaaaacaaauaaaauaagaaacacagaggccaguguuaggugaagaacuccgcugcuu

SEQ ID NO: 5595 - RNA, 62 nt, Human
gcauucuagcccagagacugucgcuacuaaaagaaugaaggaaauaauaaagugauagacag

SEQ ID NO: 5596 - RNA, 61 nt, Human
gcauugauugccccugggcguucuucccccuuaacugugaaagcagagucuauaaaugaac

SEQ ID NO: 5597 - RNA, 62 nt, Human
gcauuggggacaguuuuuauaagugggaaggacucaguauuauuauauuugagaugauaagc

SEQ ID NO: 5598 - RNA, 62 nt, Human
gcauuuaaaaaaaugccauaacuauuaaacaccuuguuuacagacagaugaaauaaauuuau

SEQ ID NO: 5599 - RNA, 63 nt, Human
gcauuuaugacccaaucuguacuaauucuccaaaccaguauuauuucaauuauggcacuuggg

SEQ ID NO: 5600 - RNA, 61 nt, Human
gcauuucuagguagugauauuuucuuccacuuaccugcugaagcacauuuaugcauuucuu

SEQ ID NO: 5601 - RNA, 64 nt, Human
gcauuugagaaaucacauuagauugaaacccuacgaaugcaguauaugugggaaagccuuuagu

SEQ ID NO: 5602 - RNA, 62 nt, Human
gcauuugccuuauuuuugcaucucacaaacauaagugcaauagaucuuuucauugaacagca

SEQ ID NO: 5603 - RNA, 63 nt, Human
gcauuuguauauuuagauuuuuugguuaagcuuugacacuggaaugaguugaaaaaaugugcc

SEQ ID NO: 5604 - RNA, 63 nt, Human
gcauuuuguauaauggccagaacuuugucgugugacaguauuagcacugccucaguuaaaggu

SEQ ID NO: 5605 - RNA, 61 nt, Human
gccaacaacuguccaacaaacaugugaaugagcccugcugaaaucagaacugaccggccca

SEQ ID NO: 5606 - RNA, 63 nt, Human
gccaacacaaaacuguguuuacugaaagccgaaaacaguauuaaaaaaaguguguaaguaaag

SEQ ID NO: 5607 - RNA, 61 nt, Human
gccaagcugcucaaugaaaccgccaggaacugaccugcugacugcacucugccaggcuucc

SEQ ID NO: 5608 - RNA, 64 nt, Human
gccaauuaacuacucugggguggcagguuccagagaaugcaguagaccuuuugccacucaucug

SEQ ID NO: 5609 - RNA, 62 nt, Human
gccaauucccacuugacagaaggcguccauccauucaucucauuggccaaggacaaacucuc

SEQ ID NO: 5610 - RNA, 62 nt, Human
gccacacacuucacgcagcgcguuguaacucauguguuuacaugucuguccccccagacugu

SEQ ID NO: 5611 - RNA, 61 nt, Human
gccacagagggggccucuugaccgacaaaggacacugugaaucacaguagcguaaacgaga

SEQ ID NO: 5612 - RNA, 61 nt, Human
gccacagggguggccgggaguugucagcugaugccugcugagaggcaggaauugugccagu

SEQ ID NO: 5613 - RNA, 61 nt, Human
gccaccaaggagcuggaccuuggaugcgccuacccugcugaggugggugacaggggccccc

SEQ ID NO: 5614 - RNA, 63 nt, Human
gccaccaugccuggccuuuggggggauuuuaauuacaguauuaauuauaguucuaggauuucc

SEQ ID NO: 5615 - RNA, 62 nt, Human
gccagacugcauuaguauuuuggcauugaaacuugugcaauaucuguguaauguagaaugug

SEQ ID NO: 5616 - RNA, 64 nt, Human
gccagaggggaugcuuagcaaacccaaucccagaguaacuggaaaauucuccaucaggaggccu

SEQ ID NO: 5617 - RNA, 62 nt, Human
gccagauuucucaagcagucucaacuccagucccucaucucacccuuacuauugcucuugcu

SEQ ID NO: 5618 - RNA, 61 nt, Human
gccagccaucacucacugccaccugggccaucaacugugaauucucagcaccaguugccuu

SEQ ID NO: 5619 - RNA, 62 nt, Human
gccaggaccugaacucgcaccuccuaccucuucauguuuacauauacccaguaucuuugcac

SEQ ID NO: 5620 - RNA, 62 nt, Human
gccaguccuugcccucccaccaggucucugagcucaguguuaccaaauucgcccuuuaacag

SEQ ID NO: 5621 - RNA, 62 nt, Human
gccaguguauucuguuuuuaaaacugugccugcagugcaauacuccuucugguguauuuuau

SEQ ID NO: 5622 - RNA, 64 nt, Human
gccaguuuaguuaacucagucauuagggggaaugcaaacuggaagggaauacggcaaugugcaa

SEQ ID NO: 5623 - RNA, 63 nt, Human
gccauagggauggucccgaguugucugacccuagggugacuuagggcagagagaauauuggcu

SEQ ID NO: 5624 - RNA, 62 nt, Human
gccauggaagauacuagcccagccuagcagaaaagugcaauauguauagcauacuuugacau

SEQ ID NO: 5625 - RNA, 62 nt, Human
gccauggccacuggcuccagcugggguuuggugccaguguuauuacagggucugcggaguau

SEQ ID NO: 5626 - RNA, 62 nt, Human
gccauuaccacaugacucaauaaaccauugcucuucaucucaggcuuugggguuggcugggg

SEQ ID NO: 5627 - RNA, 62 nt, Human
gccauucagauagcaguaaaacauucuguaugaugugcaauaaaacauccaagaucuuuuuu

SEQ ID NO: 5628 - RNA, 61 nt, Human
gccauuuacuuccagcccuuaugaggaguuuccccugcugaagagcccugccugccccaga

SEQ ID NO: 5629 - RNA, 62 nt, Human
gcccacagugacuuuugcugggcauuuucccagauguuuacagacugugaguacagcagaaa

SEQ ID NO: 5630 - RNA, 61 nt, Human
gcccaccaggucaccugcaccugcucugaauaaacugugaagucgaguuccugccucagac

SEQ ID NO: 5631 - RNA, 61 nt, Human
gcccagaggaaauucgugugaaagaggagggaaugagauuauucggaggaagggaaugggg

SEQ ID NO: 5632 - RNA, 62 nt, Human
gccccauuugcuuuuaccuguacuguauucuuggucaucucaaauggcgucuaaacccagcu

SEQ ID NO: 5633 - RNA, 62 nt, Human
gcccccagcccugggaaccacucccaccacaggcauaagcuaucaccuagcagccucaaaac

SEQ ID NO: 5634 - RNA, 64 nt, Human
gccccccuaucgggagaggggauucacaaggugaagaacuggaaccccagcuucccuccagccu

SEQ ID NO: 5635 - RNA, 62 nt, Human
gcccccugccucggugcguaccugccagugcaagcaguguuacggccaggacccgcccagcc

SEQ ID NO: 5636 - RNA, 62 nt, Human
gcccccuguaugacccuaugcaaguccuccucccucaucucaaaggguccucaaagcucuga

SEQ ID NO: 5637 - RNA, 62 nt, Human
gccccgcuuguguaacaguccuguuuuguugaguugcugcuauugcacugccagugcagccc

SEQ ID NO: 5638 - RNA, 63 nt, Human
gccccucucagagccacagguguagacaggugaaaacacuggacagugagugagcuacccaca

SEQ ID NO: 5639 - RNA, 61 nt, Human
gccccuucagcuacugccacuucgccuuacaucccugcugacugcccagagacucagagga

SEQ ID NO: 5640 - RNA, 63 nt, Human
gccccuuggaaggccaaggcaggagaaucgccucaacacuggagguggagguugcagugagcu

SEQ ID NO: 5641 - RNA, 61 nt, Human
gcccggcccggccuggcccuucaggggauggccacugugaaggacgccuucccagccugcc

SEQ ID NO: 5642 - RNA, 62 nt, Human
gcccucaucccacuggagacuggugugcggguggcaguguuaccccgugucccgggugggcg

SEQ ID NO: 5643 - RNA, 61 nt, Human
gcccucuuuugguggauguagcacaauuuccacacugugaaggcaguauuagaagacuuaa

SEQ ID NO: 5644 - RNA, 61 nt, Human
gcccugaggaccagggcuggcagauguugucuaccugcugaagaauaaagauuucuuuugg

SEQ ID NO: 5645 - RNA, 62 nt, Human
gcccugauuucucacccagagguuucacccuccuucaucucacgggcccagagcccugucuc

SEQ ID NO: 5646 - RNA, 62 nt, Human
gcccugcucugccuaaguguacuccagaagaaacucaucucauccaaauacacgcuauugag

SEQ ID NO: 5647 - RNA, 62 nt, Human
gcccuggauggcccuagggcagugggcccaugagcaguauuagucuaaaggggucggaacug

SEQ ID NO: 5648 - RNA, 64 nt, Human
gcccugguccccuuucucuugauguggaaagucugaaugcaguauuuauagacuucuaagguuu

SEQ ID NO: 5649 - RNA, 61 nt, Human
gcccuugagggcucugaguccagaguuaacugcccugcugacauccuguuagguuuccuag

SEQ ID NO: 5650 - RNA, 63 nt, Human
gcccuuuguacuucaaaauauguuuuuguguccaucaguauuaacuauugguauacuacuggu

SEQ ID NO: 5651 - RNA, 62 nt, Human
gcccuuuucucugagaagagccagcaguccacaguguuuacagagugggacuauauacaguc

SEQ ID NO: 5652 - RNA, 62 nt, Human
gcccuuuugcuggggcugccaucuugaaaucugagugcaauaggauuugcuuguaacaguua

SEQ ID NO: 5653 - RNA, 62 nt, Human
gccgagauguuauaacaaggacucguucauguauauaagcuauuucuugauccauuuaaaag

SEQ ID NO: 5654 - RNA, 61 nt, Human
gccgauccugucugcagucacaucuuuguggggccugcugacccacaagcuuuuguucucu

SEQ ID NO: 5655 - RNA, 61 nt, Human
gccggacaccugugcacucgcuccguaccuggaccugcugaaucauagcccacauguccag

SEQ ID NO: 5656 - RNA, 62 nt, Human
gccguauaucuccuuuggcaagagcuggguccagcaguguuagcagggguggcaguccuugu

SEQ ID NO: 5657 - RNA, 62 nt, Human
gccuaacuugauaucuugcucauggucuuucugucuaccucaacuccuguugucaucuuugg

SEQ ID NO: 5658 - RNA, 61 nt, Human
gccuaagaauguuugcugaaacugcuuccuagaacugugaagaaagcaggaaaguagugca

SEQ ID NO: 5659 - RNA, 62 nt, Human
gccucacugcuguucugggccauccccauagccauguuuacaugauuugaugugcaauaggg

SEQ ID NO: 5660 - RNA, 61 nt, Human
gccucagauggcuggauuuucucucaggggccuccugcugaaggggccuucagaggauuuu

SEQ ID NO: 5661 - RNA, 62 nt, Human
gccucagccaggugggccuguauauaggguccaugugcaauagggagggacgucuucuauuu

SEQ ID NO: 5662 - RNA, 63 nt, Human
gccucauauccaguccagcuagaugccaccuaaguacacuggacuuuaaaauucaguuugacu

SEQ ID NO: 5663 - RNA, 61 nt, Human
gccucauucuccaagagccacaacucaagcugaacugugaaagugguuuaacacuguaucc

SEQ ID NO: 5664 - RNA, 61 nt, Human
gccuccagccgguguccucauuccauggggcucccugcugacugcauuuccugaucuggga

SEQ ID NO: 5665 - RNA, 62 nt, Human
gccucccccagcccccuccccaucaauaaaacucuguuuacaaccaccggccgggggccccc

SEQ ID NO: 5666 - RNA, 61 nt, Human
gccuccccccaugguguuuucauaugagguacuacugugaaggaucugguuccucauucac

SEQ ID NO: 5667 - RNA, 61 nt, Human
gccuccuaaguucaaacgauucuuguaccucagccugcugaguagcugguauacaggcaca

SEQ ID NO: 5668 - RNA, 62 nt, Human
gccuccuuccuugcaguguuuacaacauagccaguguuuacagcauagcagaugcugcugcu

SEQ ID NO: 5669 - RNA, 62 nt, Human
gccucgguguccuuaucuguaaaaugggcaucaccuaccucagagggcuuuucugaggauua

SEQ ID NO: 5670 - RNA, 62 nt, Human
gccucuaacuuugugguauaagaauuauauaugaauaagcuauuauuuuuauaaaggaaaac

SEQ ID NO: 5671 - RNA, 61 nt, Human
gccucucaggcucaagcaaaccucucaccucagccugcugaguagcugggacuacaggcac

SEQ ID NO: 5672 - RNA, 62 nt, Human
gccucucucacuuuagccauggaauggcuccgaucuaccucacagcagugucagaaggacuu

SEQ ID NO: 5673 - RNA, 62 nt, Human
gccucugacaugagggacaugugacagugucauucaguauuauguucaaaagacauuuuuau

SEQ ID NO: 5674 - RNA, 61 nt, Human
gccucuggaggagcccuuggauuuucuccaugcacugugaacuucuguggcuucaguucuc

SEQ ID NO: 5675 - RNA, 62 nt, Human
gccucuuucagucuuucucccagauuccaacagucaguguuacagcauuucaccuuguucac

SEQ ID NO: 5676 - RNA, 63 nt, Human
gccugaaaaagcagguauuuucucagaccccagagcaguauuaaugaugcagagguuggagga

SEQ ID NO: 5677 - RNA, 62 nt, Human
gccugaaagauacaggggaucauguuaaaaauagcaguauuauuuuucgucucaaugguauu

SEQ ID NO: 5678 - RNA, 63 nt, Human
gccugacacagacauccuuuccucucacaagcugugugacuuaguagauaaaauacugccuuc

SEQ ID NO: 5679 - RNA, 61 nt, Human
uauuuucauaucaccuccaucccauaaaguuguacugugaacuggaagaugguggaauguu

SEQ ID NO: 5680 - RNA, 64 nt, Human
uauuuuccacugagagacgcaaucaugauuuaauugaacuggaaguuuaagacugcuccucagc

SEQ ID NO: 5681 - RNA, 61 nt, Human
uauuuuccauguauuacaaaaggaaaaaaaaauugagauuacacuggcauaaacucuaguu

SEQ ID NO: 5682 - RNA, 61 nt, Human
uauuuucggggagaggaucuuguuauuguuuccugagauuauuuaaaauguuuuuucuuug

SEQ ID NO: 5683 - RNA, 64 nt, Human
uauuuucuacagauuuugaaaaauguaauaauauuaaugcaguauugcaacaggggugcaauuu

SEQ ID NO: 5684 - RNA, 62 nt, Human
uauuuugaaaggagaaaaaaaaagccacuaaggucaguguuauaaaaucuguauugcuaaga

SEQ ID NO: 5685 - RNA, 63 nt, Human
uauuuugcuuuauguauauuacaguucuuuuuaaaacacuggaagacucauguuaaacucuaa

SEQ ID NO: 5686 - RNA, 62 nt, Human
uauuuuguacagaaaauaucaaccucuucccuuuuguuuacaagauguuuuguauaagccua

SEQ ID NO: 5687 - RNA, 61 nt, Human
uauuuuguuuuuuuccaauucuuuacuuuugauacugugaagaucuuucgugccgaaagau

SEQ ID NO: 5688 - RNA, 62 nt, Human
uauuuuucaauuggcaauucaguuaauuuuuaaauguuuacauaauggccagaaggcuugca

SEQ ID NO: 5689 - RNA, 62 nt, Human
uauuuuucaucuucaaacacaguacaaaaauuaccaguauuaccauaacugagauaaagauc

SEQ ID NO: 5690 - RNA, 62 nt, Human
uauuuuuguauuuuucucugguugggaguaugauaugaaggaucaagauccucaacucacac

SEQ ID NO: 5691 - RNA, 62 nt, Human
uauuuuuguugccuuuuuugcuuuuuuuuaaucugugcaauaccucauuuaaucuguaaagg

SEQ ID NO: 5692 - RNA, 62 nt, Human
uauuuuuuucauauguguaggugaaaugguaugaauaagcuaacaggaauaguaucuaaaaa

SEQ ID NO: 5693 - RNA, 62 nt, Human
uauuuuuuuuaagucuucuugaaggcacucuaauugcugcuaaaugauguugcuucuuugcu

SEQ ID NO: 5694 - RNA, 61 nt, Human
ucaaaaacaugaacagucacauacuugagagaaacugugaauguaagguguaggaaaguac

SEQ ID NO: 5695 - RNA, 62 nt, Human
ucaaaagcucaauguacugcccaagaggcaccuugugcaauauucccaucccugaauuuagc

SEQ ID NO: 5696 - RNA, 61 nt, Human
ucaaaaggaaaucaaaguugcuaguaaaauguuugagauuacauuuagaacuaacugauaa

SEQ ID NO: 5697 - RNA, 61 nt, Human
ucaaaaugaccugauaaauugauaagacaaagaugagauuauuggggcuguucauauuaug

SEQ ID NO: 5698 - RNA, 61 nt, Human
ucaaacaaaugugacuuaugcuggugcccucgcccugcugaucagauucugguucaaauuc

SEQ ID NO: 5699 - RNA, 63 nt, Human
ucaaacaauggaagaacuugcauuuuuauggaacucaguauuaaaagaaaaauauaaugugaa

SEQ ID NO: 5700 - RNA, 61 nt, Human
ucaaacucaaauaucuuugcaaacaguuugaauacugugaauucauuacgaagaauguucg

SEQ ID NO: 5701 - RNA, 63 nt, Human
ucaaagaauuuagguauuuguuucaccgaaaugaagugacuuauuagccauucagcguauuag

SEQ ID NO: 5702 - RNA, 61 nt, Human
ucaaagacauggaaguugcuucagauaucugauacugugaauguuugaacauauccguggc

SEQ ID NO: 5703 - RNA, 64 nt, Human
ucaaagaccauuggcauucagaggaugcuggacauuaacuggaacugcuacuuccaauucaaua

SEQ ID NO: 5704 - RNA, 59 nt, Human
ucaaaggaaugcggucuaacccacaggcugcccugcugaccacacuaccuggaccuggg

SEQ ID NO: 5705 - RNA, 61 nt, Human
ucaaauaaugaucaaugcuauuucagugagcaaacugugaaaggggcuuuggaaagaguag

SEQ ID NO: 5706 - RNA, 64 nt, Human
ucaaauucuuugccgcaaggcugaucugcuuucauuaacuggaauucuguaggagauacuggug

SEQ ID NO: 5707 - RNA, 61 nt, Human
ucaacacacugcuuccuuccuccagaaggucuuacugugaaggaaaaaaugucaguugaac

SEQ ID NO: 5708 - RNA, 61 nt, Human
ucaacaggccccauugccugggguuguuacugcugagauuaagggaugcucguccauagaa

SEQ ID NO: 5709 - RNA, 64 nt, Human
ucaacauuccaaacugccaauuuguauuauguccaaaugcaguauccuugaggaauauaguggg

SEQ ID NO: 5710 - RNA, 61 nt, Human
ucaacauuguagggggcaagcuuuggugcgcccccugcugaggagcagccccaggagggga

SEQ ID NO: 5711 - RNA, 61 nt, Human
ucaaccuaggagauuuuucuaccucuuuacuacccugcugaaguugcucuucagcagaaaa

SEQ ID NO: 5712 - RNA, 64 nt, Human
ucaacuccguaaaaaagacagcuguauuuuccguccaacuggaauuguugaaucacacugcaua

SEQ ID NO: 5713 - RNA, 61 nt, Human
ucaacuccugucucuccauauaccagcaguguaacugugaauaacauacuuaaauggcugu

SEQ ID NO: 5714 - RNA, 61 nt, Human
ucaacuugaaagagaaaaggcaauuguaagcauugagauuacacagauguugaaacuaucc

SEQ ID NO: 5715 - RNA, 63 nt, Human
ucaagaaaauccaggcuaucacauagucuuucugugugacuuauuaggagauaggaagagcau

SEQ ID NO: 5716 - RNA, 62 nt, Human
ucaagacccagaauguaggugccacugccuccuauguuuacaggauccuccguggcccuagg

SEQ ID NO: 5717 - RNA, 62 nt, Human
ucaagacuagccugggcaauguggcaaaaccgcguguuuacaaaaaauacaaaaauuagcca

SEQ ID NO: 5718 - RNA, 62 nt, Human
ucaagauagagcauuccuucuuguaucaguggggcaguguuaccauaaacacgguguauaug

SEQ ID NO: 5719 - RNA, 61 nt, Human
ucaagaugaaacucuuuccccagcaguuuagugccugcugaaaagaucccugauggacaau

SEQ ID NO: 5720 - RNA, 64 nt, Human
ucaagaugguucauuauggcuguguucaccauagcaaacuggaaacaaucuagauauccaacag

SEQ ID NO: 5721 - RNA, 61 nt, Human
ucaagcaauccucccaccuuggccucaaaguauugagauuacaggcaugagccacugcacc

SEQ ID NO: 5722 - RNA, 62 nt, Human
ucaagcagugcaacuuguaauuaagcagcugcaguguuuacauguuucuuaaugugucaucu

SEQ ID NO: 5723 - RNA, 62 nt, Human
ucaagcuuacacuucauauggaguuaaacuuggucaguguuaauaaaaucaaaacgugauuc

SEQ ID NO: 5724 - RNA, 64 nt, Human
ucaaggcaguggcagaagaugucagucaccucugauaacuggaaaaaugggucucuugggcccu

SEQ ID NO: 5725 - RNA, 61 nt, Human
ucaaguacuggcuggacaggcuaguucuuucagacugugaaauuaaugaaugagcaaaaua

SEQ ID NO: 5726 - RNA, 62 nt, Human
ucaaguggggaaucgggcgccugauugcugagugucaucucaaccccaucauccugccccug

SEQ ID NO: 5727 - RNA, 61 nt, Human
ucaauauggaccauuuaggaauuauaagcagcaacugugaaagacuugccacucaauaucu

SEQ ID NO: 5728 - RNA, 63 nt, Human
ucaaucagcauuguuauuuaucauuaagguauugaacacuggauugcaugguugaaugugucu

SEQ ID NO: 5729 - RNA, 61 nt, Human
ucaaugcagaauauugaggguugaaucuccuggugagauuauacaggagauucucuuucuu

SEQ ID NO: 5730 - RNA, 64 nt, Human
ucaauggguuacuucauuaaaagcagccccacaaguaacuggaaaucugaagaccaggggacaa

SEQ ID NO: 5731 - RNA, 63 nt, Human
ucaauuaagucccaauuugccacuugguauugaguacacuggacccugaccacuggcucuugg

SEQ ID NO: 5732 - RNA, 62 nt, Human
ucaauuaccucccauguguggacauccugggacuuguuuacauuuuaucuguaauaagauaa

SEQ ID NO: 5733 - RNA, 63 nt, Human
ucaauucuguaaguggugacuuuuugagcaccuuucaguauuauguauuuguaaaaaccauug

SEQ ID NO: 5734 - RNA, 63 nt, Human
ucacaaauguaggucuguauuacuuguaugcuugugugacuuacuguuaguccagcucuaaaa

SEQ ID NO: 5735 - RNA, 62 nt, Human
ucacaaugaaguucuucauccaguagguguuuaacaguguuauuuugccacugguaaugugu

SEQ ID NO: 5736 - RNA, 61 nt, Human
ucacacuuaucuauaguaugcuuuuugugguguccugcugaauuuaaauauuuauguguuu

SEQ ID NO: 5737 - RNA, 53 nt, Human
ucacagggaaggauucuaaaaagguaugcaguacagcaguauagaauccaugc

SEQ ID NO: 5738 - RNA, 62 nt, Human
ucacaucgcuucuguguaucucuuucacauuguuugcugcuauuggaggaucaguuuuuugu

SEQ ID NO: 5739 - RNA, 62 nt, Human
ucacaugacuucaguaaucuuugggaaauaaagacaguguuaaaaucauugguaaaaaaaau

SEQ ID NO: 5740 - RNA, 62 nt, Human
ucacauuuuuuaaaagggcaaguacaggagcaacugcugcuacccagaaaaauguguguauu

SEQ ID NO: 5741 - RNA, 63 nt, Human
ucaccaacauauuguggcuggacagcaggcaguacacacuggagaaagacugaaugccgugaa

SEQ ID NO: 5742 - RNA, 61 nt, Human
ucaccauuauuagauauauguacuuuuguaaugacugugaaauacacuuuucccucacuac

SEQ ID NO: 5743 - RNA, 63 nt, Human
ucacccccaaacccccaucccuuccccaccuccagcaguauuacuuguaacgcaauucaggga

SEQ ID NO: 5744 - RNA, 61 nt, Human
ucacccuugcugggggcauaucucucauacccaccugcugaaucuucucuucacuugcuga

SEQ ID NO: 5745 - RNA, 62 nt, Human
ucacccuugcuguucuucucaaucucuugcucuaaugaaggaacuguguaucucaaaaacca

SEQ ID NO: 5746 - RNA, 62 nt, Human
ucaccuaaaaaagaguguguugauggcaguuccaaugaaggacaacuaauuuauaacuuguu

SEQ ID NO: 5747 - RNA, 61 nt, Human
ucaccuccccuccuugaaaucugggcccuggugccugcugaagauucccucuaucccugag

SEQ ID NO: 5748 - RNA, 63 nt, Human
ucaccugagacaggaaacagggaguucauuuggccacacuggaagaaaggcaagaaagaggaa

SEQ ID NO: 5749 - RNA, 63 nt, Human
ucaccuggcuguggcuggcccugugugggguggguacacuggaaaacaagaagguuggaguug

SEQ ID NO: 5750 - RNA, 62 nt, Human
ucaccuuuggugggggcagggccugguggcaccugugcaauaaugucuguguuucucuccca

SEQ ID NO: 5751 - RNA, 64 nt, Human
ucacgcagacaggaaggguguuugcgcacucugaucaacuggaaccucuguaucaugcggcuga

SEQ ID NO: 5752 - RNA, 62 nt, Human
ucacgguagccuccaccuucugggcucaauccuccuaccucagccuuccaaguagcugggac

SEQ ID NO: 5753 - RNA, 62 nt, Human
ucacggugacaccaccuuccugaggcuucccuccugcugcuaccacugaugcgagggaaagg

SEQ ID NO: 5754 - RNA, 61 nt, Human
ucacguagaccucacuguaccacuaacugcaauacugugaacuggaagcaaacaccugccu

SEQ ID NO: 5755 - RNA, 62 nt, Human
ucacguuuguaguaucauaucaaaaauucuaaccuguuuacauuguuuucauguucauguuc

SEQ ID NO: 5756 - RNA, 64 nt, Human
ucacuaaugagaauaauauucgggauuuuaaagcacaacuggaauagcuaauuacagucuauua

SEQ ID NO: 5757 - RNA, 62 nt, Human
ucacucccguggugguguuugagagccaacaacacuaccucagagacgggucuuugggaaac

SEQ ID NO: 5758 - RNA, 62 nt, Human
ucacugaaauaucucucccuuauggcaauccuagcaguauuaaagaaaaaaggaaacuauuu

SEQ ID NO: 5759 - RNA, 62 nt, Human
ucacugauguuauucccccaucugccgucuugguucaucucaccacagaagggcauuuaguc

SEQ ID NO: 5760 - RNA, 63 nt, Human
ucacuggaguuuuuuuuuuuuuuaacuauuaaauaaacgguuauuuuacaggcagaaccugug

SEQ ID NO: 5761 - RNA, 62 nt, Human
ucacuggauuuacuuuaaguauucccauacuagacaguguuauguaauguagacaugacucu

SEQ ID NO: 5762 - RNA, 62 nt, Human
ucacuggcaaguguuuguggaguuuccauggugauguuuacauccagggacaguuucgucuc

SEQ ID NO: 5763 - RNA, 61 nt, Human
ucacuuaauuuauuuccguuuuuguuucugguuacugugaaucccagaggagucucucccu

SEQ ID NO: 5764 - RNA, 62 nt, Human
ucacuuacuauccauuucuucauguuaaaagaagucaucucaaacucuuaguuuuuuuuuuu

SEQ ID NO: 5765 - RNA, 62 nt, Human
ucacuuugcuggccuuugaaauguguucuccgugauaagcuauccauguguuugugauaaga

SEQ ID NO: 5766 - RNA, 62 nt, Human
ucagaaacauucagguuugaagccagcccugauaaugaaggaugaacuagugugauuucuaa

SEQ ID NO: 5767 - RNA, 62 nt, Human
ucagaagaugauuuuaacaguucagaacagaugugugcaauauuggugcauguaauaauguu

SEQ ID NO: 5768 - RNA, 62 nt, Human
ucagaaggcaaguggugauggcgccacugcacuccuaccucagcaacagaguaagacucugu

SEQ ID NO: 5769 - RNA, 63 nt, Human
ucagaaugcugaauaaccuuguagcuagcaauaaggugacuuacaguuguauaaacaggaagc

SEQ ID NO: 5770 - RNA, 62 nt, Human
ucagagauugggagaaauacaagaugagccugaaucaucucauguaccugacaguaagaaaa

SEQ ID NO: 5771 - RNA, 62 nt, Human
ucagaguauagaaagaucuucauuugaaaaccaucuaccucagcauuuacugagcauuuuaa

SEQ ID NO: 5772 - RNA, 64 nt, Human
ucagagucccgcagguaccccagcucugcuugccgaaacuggaaguuauuuauuuuuuaauaac

SEQ ID NO: 5773 - RNA, 62 nt, Human
ucagauaucaccucacccagccucagaaguuguugugcaauaaaagguugagcauucaaccc

SEQ ID NO: 5774 - RNA, 62 nt, Human
ucagaucugaaguauggucuugguccugaauauacaguguuauccuauguuuaaaaggguga

SEQ ID NO: 5775 - RNA, 63 nt, Human
ucagaugagacauauuaacuuagacuaaacgugaacaguauuauauggacucucacaacgcuc

SEQ ID NO: 5776 - RNA, 61 nt, Human
ucagauuuccccaguguuuuguugucuguuguaccugcugaaacuacaguaguugaauauu

SEQ ID NO: 5777 - RNA, 62 nt, Human
ucagcaaacucgggacauuauuuugguuugacucucaucucauuagacauuggagaguuuac

SEQ ID NO: 5778 - RNA, 61 nt, Human
ucagcacagauguggcagagggaauggucugauccugcugaaagccauuaaggagaaacga

SEQ ID NO: 5779 - RNA, 62 nt, Human
ucagcaucaacacaauuuccaggggaccucaggucuaccucaggacugaacgccacaccuca

SEQ ID NO: 5780 - RNA, 62 nt, Human
ucagcauucaaucaggcugagcugaauguagugauguuuacauuguuuacauucuuuguacu

SEQ ID NO: 5781 - RNA, 62 nt, Human
ucagcuugaccaguauaaaauuacaguggauugcucaucucaguccucaaagcuuuuugaaa

SEQ ID NO: 5782 - RNA, 62 nt, Human
ucaggaaaucuuguaguuuauuguuguuauuuaacaguauuaaguggauuuuuguauauuuc

SEQ ID NO: 5783 - RNA, 64 nt, Human
ucaggaccuggcuuggcuuuaaccguuuuucaagaaaacuggaaaucuggauuuucagcgaaca

SEQ ID NO: 5784 - RNA, 62 nt, Human
ucaggagcuggcaucaaacucguagucccauagucaguguuaauuacacacauuguuaacua

SEQ ID NO: 5785 - RNA, 64 nt, Human
ucaggagucaauucaguguuguacuggugaccugggaugcaguaguaggcacuguugauucaaa

SEQ ID NO: 5786 - RNA, 63 nt, Human
ucaggaguuagaauucucucagaagggucuaugaucaguauuacuuuauuaagaauuaccuuu

SEQ ID NO: 5787 - RNA, 62 nt, Human
ucaggcucaugauaaauguauuagucuguucucaugcugcuauuaaagacauaccugacacu

SEQ ID NO: 5788 - RNA, 63 nt, Human
ucagggagagaugaaaauaauaggucagaaugcaagugacuuaaucacagucuuccuagaauu

SEQ ID NO: 5789 - RNA, 62 nt, Human
ucagggaucuguaaagaucauuuaaauggagugcucaucucauugaggagcagauuaauuuu

SEQ ID NO: 5790 - RNA, 62 nt, Human
ucagggccccccugccccaccgcacccccagaauauaagcuaucaagaguauuaauuuauug

SEQ ID NO: 5791 - RNA, 62 nt, Human
ucaggugguaacuccccaaccugacauugguacugugcaauaaagacacccccuacccucua

SEQ ID NO: 5792 - RNA, 62 nt, Human
ucagguucugugcucuuuuuggagucuuuaagcucaguauuagucuauugcagcuaucucgu

SEQ ID NO: 5793 - RNA, 62 nt, Human
ucagguuuucuauuccuuucuguguuugcaaauucaguguuaacuaaauaaagguauuuugu

SEQ ID NO: 5794 - RNA, 61 nt, Human
ucaguaaaccacacaaaucagguaaguguucuaugagauuagcuggcuaugagaaacauaa

SEQ ID NO: 5795 - RNA, 64 nt, Human
ucaguauaacagagcaauuggaagagaauaugaaaaaacuggaaucuaaauagucagugaggaa

SEQ ID NO: 5796 - RNA, 62 nt, Human
ucagucaaggaaaggccacuuaaggaucugcucuaugaaggagaagaaagaggaaaaagaag

SEQ ID NO: 5797 - RNA, 62 nt, Human
ucaguguagucauucauuucuagcuguacauaggaugaaggagagaucagauacaugaacau

SEQ ID NO: 5798 - RNA, 62 nt, Human
ucaguucccucaccuguaaaaaugaggguagucccuaccucauaagggauauugugaggaug

SEQ ID NO: 5799 - RNA, 63 nt, Human
ucaguuuccauuucauuuuuuuuuuucuaguuuuggugacuuagugauuuugucauuuuuuac

SEQ ID NO: 5800 - RNA, 62 nt, Human
ucaguuuccucaucuguaaggggggcaaugauaccuaccucacagggguguugugaggauua

SEQ ID NO: 5801 - RNA, 62 nt, Human
ucauaaaguuugauuggaacauaccaugcucauuuguuuacauaucaucugcagcuguuuuu

SEQ ID NO: 5802 - RNA, 62 nt, Human
ucauaauaaagauaaaauuuaguugaguuuuuaauguuuacauguuuacaucucuaaauaaa

SEQ ID NO: 5803 - RNA, 64 nt, Human
ucauaauucugcagagacuuccaguuuauugcauauaugcaguaaaguguauauauuaugcagu

SEQ ID NO: 5804 - RNA, 63 nt, Human
ucauacacuucuuaaaaugugaaaaucuauguuuucaguauuaugacaguaucugcagauacu

SEQ ID NO: 5805 - RNA, 64 nt, Human
ucauaccaacagccucuccuuguacuauauuuuuaaaacuggaacuaugaacuucauccauuug

SEQ ID NO: 5806 - RNA, 63 nt, Human
ucauacuaaauaauauuauauacaguuuuguuauugugacuuacauuuuuguuacuucuaaaa

SEQ ID NO: 5807 - RNA, 63 nt, Human
ucauagagcaacacauguggcacaugugagauuucacacuggacaaaacaggguuagcaucuu

SEQ ID NO: 5808 - RNA, 63 nt, Human
ucauagagcaacacuuguggcacaugugagauuucacacuggacaaaacaugguuagcauccu

SEQ ID NO: 5809 - RNA, 64 nt, Human
ucauagcuauuuugugcuugaucuuuauugucuaagaugcaguauccuguacuagcuuauaaua

SEQ ID NO: 5810 - RNA, 62 nt, Human
ucauagcuuguuuuauuuugugcuauaaaauuaacaguauuaaaugacuuauauucuuagaa

SEQ ID NO: 5811 - RNA, 64 nt, Human
ucauagugccucacaggguuggucaauggcuuuuggaacuggaaggaccuuagaacuuaucugu

SEQ ID NO: 5812 - RNA, 63 nt, Human
ucauaugaagaccauaaaugugggaaagccuuugucaguauuaaucccuuaauugacauaagu

SEQ ID NO: 5813 - RNA, 63 nt, Human
ucauaugaagucaauaaaugugggaaagccuuugucaguauuaaucccuuaauugaccuaagu

SEQ ID NO: 5814 - RNA, 62 nt, Human
ucauauguagcaaccccuccuccccuccugggcauguuuacacaggcucugcucugggggcu

SEQ ID NO: 5815 - RNA, 61 nt, Human
ucaucagaaucgugacuauuauugcuccaucaaacugugaaaagaaaugauguggaccuug

SEQ ID NO: 5816 - RNA, 61 nt, Human
ucaucaguuggcuacguuuugguucuaugcuaaacugugaaaaaucagaugaauugauaaa

SEQ ID NO: 5817 - RNA, 63 nt, Human
ucaucauggcgguacuauuuuuuaaaagaaauuaaacacuggaucucuccuuaagccaacauu

SEQ ID NO: 5818 - RNA, 63 nt, Human
ucaucgcaaaaaggcgauuugagaaaugugggcuucaguauuaauugccauuuugcugacacc

SEQ ID NO: 5819 - RNA, 61 nt, Human
ucaucucaggggaggcaguggcaccucccucucccugcugacaugaagagagcuaugauau

SEQ ID NO: 5820 - RNA, 62 nt, Human
ucaugaacuuugagaaugggcuuccuuuuugguucaguauuagugagagggagagggagaug

SEQ ID NO: 5821 - RNA, 62 nt, Human
ucaugaaggacucugaauagacuuggccaacugauguuuacaaaccagacuuuuauauuuua

SEQ ID NO: 5822 - RNA, 61 nt, Human
ucaugauccacccaccucggccucccaaagugcugagauuacagacgugagccacugcguc

SEQ ID NO: 5823 - RNA, 61 nt, Human
ucaugauccgcccaucuuggccucccaaagugcugagauuacaggcaugagccaccgcacc

SEQ ID NO: 5824 - RNA, 61 nt, Human
ucaugaucuacccgccuuggccucccaaagugcugagauuacaggcgugagccaccgugcc

SEQ ID NO: 5825 - RNA, 62 nt, Human
ucaugcaugcaguggggauuccaguaaguaccaacuaccucacaggcauggcacggaggcaa

SEQ ID NO: 5826 - RNA, 62 nt, Human
ucaugcauuagagucaguucuggcucugccuagcuguuuacauuugcaaauguagcaaacaa

SEQ ID NO: 5827 - RNA, 62 nt, Human
ucaugcauucccacugaucacaaaacccauacuacuaccucauugacaccauaccugcuaac

SEQ ID NO: 5828 - RNA, 62 nt, Human
ucaugcccauuuucugcuguuucugaugggucagcuaccucacggcggggccagcucugcug

SEQ ID NO: 5829 - RNA, 62 nt, Human
ucaugccugauauuucagcccauugacuugcuggaugaaggacuagaauacagcagcuguua

SEQ ID NO: 5830 - RNA, 62 nt, Human
ucaugcucucagagcagggaacagcgggggaaaauguuuacacuccaugcacaaucugugcu

SEQ ID NO: 5831 - RNA, 63 nt, Human
ucaugcucugucugcccaggcuguguagauucugugugacuuagucucuugugcugaguguuu

SEQ ID NO: 5832 - RNA, 61 nt, Human
ucauggcaagcugguguuuaagaggucaggaggccugcugaucuuucaaaggacacccaug

SEQ ID NO: 5833 - RNA, 62 nt, Human
ucaugggacccucucuaauccuuccaccaaucaaauaagcuauugcuauugguuuggaguug

SEQ ID NO: 5834 - RNA, 62 nt, Human
ucaugguuguuaacauuguguaauaugucucuauaugaaggaacuaaacuauuucacugaaa

SEQ ID NO: 5835 - RNA, 62 nt, Human
ucauguaaguagcaaacagggcuuuacuaucuuuucaucucauuaauucaauuaaaaccauu

SEQ ID NO: 5836 - RNA, 62 nt, Human
ucauguacacaaagaccaucgagacggccauucuuguuuacaaaacacuuaccaagaaagca

SEQ ID NO: 5837 - RNA, 64 nt, Human
ucaugucauagcugaacccuacucuacuggauucaaggccaguaaaugcaauuuagagaagcag

SEQ ID NO: 5838 - RNA, 62 nt, Human
ucaugugcuugaacaugaugcuaacccugacaggaugaaggaaaguaauauucuuucagugu

SEQ ID NO: 5839 - RNA, 63 nt, Human
ucauguguacauuuuuaaucuguuauaguuggcggcaguauuaaaauggugaguaaagagccc

SEQ ID NO: 5840 - RNA, 61 nt, Human
ucauguuaacuagaguguacaaaaagucuguuuccugcugagccaauagugauuuguuugc

SEQ ID NO: 5841 - RNA, 62 nt, Human
ucauguuccuuuugaaauuguagugcaaaauggucaguauuaucuaaaugaaugagccaaaa

SEQ ID NO: 5842 - RNA, 64 nt, Human
ucauucacuggaaauguagauugauguucaauguuaaacuggaaggagcuugguuuguguguca

SEQ ID NO: 5843 - RNA, 62 nt, Human
ucauucguaccaugccaaacgcauucacucggggcaguauuaaccguucuagaaagccacug

SEQ ID NO: 5844 - RNA, 62 nt, Human
ucauucuaacuuggaaaauaaugcaauugggucacaguguuaaaaaucuagaaaagacuugu

SEQ ID NO: 5845 - RNA, 64 nt, Human
ucauugcacagaagggaaaggucucaaggaagagucaacuggaacaagcacaagcccaccggac

SEQ ID NO: 5846 - RNA, 62 nt, Human
ucauuggugagagcccaggccauuaacaccuacacaguguuauugaaagaagagaggugggg

SEQ ID NO: 5847 - RNA, 62 nt, Human
ucauuguucuuuuaguuuguauucuuauaaaaaauguuuacacucugcagauugauuuuuuu

SEQ ID NO: 5848 - RNA, 63 nt, Human
ucauuuaaagcuaugggaggguugcuuugauuacaacacuggagagaaaugcagcauguugcu

SEQ ID NO: 5849 - RNA, 62 nt, Human
ucauuuaaucuuuacuacacuccugcaacauagacaguauuauuacauucaguauuacaaug

SEQ ID NO: 5850 - RNA, 61 nt, Human
ucauuuagccauugcacagucagcugcagaaguccugcugaccaccuagucauggacaaag

SEQ ID NO: 5851 - RNA, 62 nt, Human
ucauuuauguuauuuaaaugauguacuguacugcuguuuacauggacguuuugugcgggugc

SEQ ID NO: 5852 - RNA, 64 nt, Human
ucauuucuacuugcaguacugcuaugugcuaagcuuaacuggaagccuuggaaugggcauaagu

SEQ ID NO: 5853 - RNA, 61 nt, Human
ucauuucuuggaaaaggccuccuuccuccagugccugcugaaccaucuuagggucacucac

SEQ ID NO: 5854 - RNA, 61 nt, Human
ucauuugaaugaaaaucuuaucacauuaaauucacugugaaggcagcauacuuaaauuuuu

SEQ ID NO: 5855 - RNA, 62 nt, Human
ucauuuuaaguccaaagugaaacacuugauuugaauaagcuaguuuauaaacuaaagcuguu

SEQ ID NO: 5856 - RNA, 62 nt, Human
ucauuuuucaaggagaagagccugcaaauggccaaugaaggagguaaauaaacuaagauauu

SEQ ID NO: 5857 - RNA, 62 nt, Human
uccaaaagccucugcccaggagcaugggcaucagcuaccucacgggaaccagccugcuguuc

SEQ ID NO: 5858 - RNA, 62 nt, Human
uccaaacacagcguugacauuuuuacugaggagaucaucucaaaggugaugccaaacgaguc

SEQ ID NO: 5859 - RNA, 62 nt, Human
uccaaacugauuaaguuacaguuuaagcacccuucaguauuaauauauacgguauuauauaa

SEQ ID NO: 5860 - RNA, 62 nt, Human
uccaaagaaacccuauauuauauauccacauuacugcugcuaggauucauaguugcacauac

SEQ ID NO: 5861 - RNA, 61 nt, Human
uccaaagcaugggauucuggaggcagccagagcccugcugaguuccugcuuucugaccugg

SEQ ID NO: 5862 - RNA, 62 nt, Human
uccaaaugcuuuuccccaaauugucuaauauaucauaagcuaguguuuccuuguauuuaauu

SEQ ID NO: 5863 - RNA, 62 nt, Human
uccaacacuagaaagcaaugacuaacauuuaauuuguuuacaaaaauguuuauugucuucag

SEQ ID NO: 5864 - RNA, 62 nt, Human
uccaaggaguggggucuacgugaccuuuaguccucuaccucagagccccgagucauuucuga

SEQ ID NO: 5865 - RNA, 63 nt, Human
uccaaggcaaauguccaagcaucagcaagacaaugacacuggaaggguccggcuuggcuaguc

SEQ ID NO: 5866 - RNA, 62 nt, Human
uccaccagacuggcgugucauuggacagauaaaccaguguuagcuugccucugggcugggug

SEQ ID NO: 5867 - RNA, 61 nt, Human
uccaccucacuccuccaugggcuucuugagacaccugcugaccucuagccggaccugagcu

SEQ ID NO: 5868 - RNA, 61 nt, Human
uccaccuuuuagcccacaucauuuaacuccacuacugugaaagcuugcuuaaagaaaaucc

SEQ ID NO: 5869 - RNA, 62 nt, Human
uccacugcauauaucacaauuacauuuuuuucaacaguguuaaggcaaaauuuauaguaaua

SEQ ID NO: 5870 - RNA, 62 nt, Human
uccacuuaccuagauucuacauauucuuuaaauuucaucucaggccucccucaaccccacca

SEQ ID NO: 5871 - RNA, 64 nt, Human
uccagacauuuggaauugcauauuaaggaagcccagaacuggaagcuuggaggaaagcauacug

SEQ ID NO: 5872 - RNA, 64 nt, Human
uccagcccccucugcauuuacacagauuugagucagaacuggaaagugucccccacccccacca

SEQ ID NO: 5873 - RNA, 64 nt, Human
uccagccuggcugcugcugggcccugaauaaagagaggccaguacaaagcccauggauuuuggg

SEQ ID NO: 5874 - RNA, 61 nt, Human
uccagcucacccagaaccuucaccagcaaaccuccugcugagguccuggcaggaggccacc

SEQ ID NO: 5875 - RNA, 64 nt, Human
uccagcuguuugguuauuucucuggauuaacuguucaacuggaaaauuuuuaguuuuucuagcc

SEQ ID NO: 5876 - RNA, 62 nt, Human
uccaggacaaacuccgccuccccuuaguggaaaccaguauuaacccagagguuugggcaacu

SEQ ID NO: 5877 - RNA, 61 nt, Human
uccaggcccugggaugugggcuuguguuuugucacugugaagggggagaugggagaggagc

SEQ ID NO: 5878 - RNA, 62 nt, Human
uccaggccgggccuauacagaggugcuggcugcuuguuuacauucuccucuggggcucuacc

SEQ ID NO: 5879 - RNA, 62 nt, Human
uccagggauauaacuccuuggucagugauuuuauuguuuacauccugagacuguucuacagu

SEQ ID NO: 5880 - RNA, 62 nt, Human
uccaguaaaauaacagcaaugacaaugagaucgucaguauuauuuucacauuucccugagag

SEQ ID NO: 5881 - RNA, 62 nt, Human
uccaguuauuagcaaacucagacgaauguaccgccaguauuaucagcagucaacaagcaccu

SEQ ID NO: 5882 - RNA, 61 nt, Human
uccaguuauuuauaugcccaacaaauuucauagccugcugaacugaacugagugugucaga

SEQ ID NO: 5883 - RNA, 62 nt, Human
uccaguuggcuacacagugccagaaaggaaucugucaucucaggaaagccccucaaagaugg

SEQ ID NO: 5884 - RNA, 61 nt, Human
uccaguuuuagcauauaugcugccaagcauagaacugugaaggagaacuguuaaaggcggc

SEQ ID NO: 5885 - RNA, 62 nt, Human
uccaguuuuucauguuugccucaaguaaucuuuacaguguuacaaauuauuugcuuaagaag

SEQ ID NO: 5886 - RNA, 62 nt, Human
uccauaugccucccuaugcagugaagggcccuagcaguguuaacaaauugcugagaucccac

SEQ ID NO: 5887 - RNA, 62 nt, Human
uccauauuaaauuuauauggcuauaaauuucaucuguuuacauccugauuuguauacuauuu

SEQ ID NO: 5888 - RNA, 62 nt, Human
uccaucaacccuaaaauggggauaauuaucguaucuaccucaagauuguuuugucaggaggg

SEQ ID NO: 5889 - RNA, 62 nt, Human
uccaucacuaaaggccaaucagaauuuggaaccaugcugcuacccaagaaaucuaauggaau

SEQ ID NO: 5890 - RNA, 62 nt, Human
uccaucauguuuuaacauacuguauacucuauagcaguauuacagucaguauuucauauaau

SEQ ID NO: 5891 - RNA, 64 nt, Human
uccaugaagugcucucguucucaguagcggcaucauggccaguagugucuuugaggaguucacc

SEQ ID NO: 5892 - RNA, 61 nt, Human
uccaugugacuuccaagcaggcccuccgcccucccugcugaauggaggagccggggguccc

SEQ ID NO: 5893 - RNA, 63 nt, Human
uccauguuagcucaugguguaagaugaugucuugucaguauuacuguuuugcuaagccgcuuc

SEQ ID NO: 5894 - RNA, 61 nt, Human
uccauuuauaucagggauucuauuuacuugaagacugugaaguugccauuuugucucauug

SEQ ID NO: 5895 - RNA, 63 nt, Human
uccauuucccaucucagcuucaagggaggugucagcaguauuaucuccacuuucaaucucccu

SEQ ID NO: 5896 - RNA, 62 nt, Human
uccauuugcuacugccuagucuugguuccuuaugcaguauuauagggcagccuuuuuagagc

SEQ ID NO: 5897 - RNA, 62 nt, Human
ucccacagcuuuaaauacugaggaaaauguggccuguuuacaaaacauucagcacguugaag

SEQ ID NO: 5898 - RNA, 61 nt, Human
ucccaccuuccucccaccucaccugucgcacccacugugaaaguuggaauauguggucucc

SEQ ID NO: 5899 - RNA, 62 nt, Human
ucccacuuucagcaguccuuugcucucuuugcuucuaccucaaauagccccaggagugggcu

SEQ ID NO: 5900 - RNA, 62 nt, Human
ucccagaucauuugaaauuucuggcugccuuacuuguuuacagauaguuuaagacuauuuaa

SEQ ID NO: 5901 - RNA, 61 nt, Human
ucccagauggacucuggcccuuaccuccccaccugagauuagggugaguguguuugcucug

SEQ ID NO: 5902 - RNA, 61 nt, Human
ucccagcacaugacaacacuucagaagggucccccugcugacuggagagcugggaauaugg

SEQ ID NO: 5903 - RNA, 64 nt, Human
ucccagcagccgguucuggguagcagaucaauuuccaacuggaaaauaacuauauaauguaugc

SEQ ID NO: 5904 - RNA, 62 nt, Human
ucccagccgucuuacuacaguccuguaaauuuaagugcaauauauagaaacauauggauaua

SEQ ID NO: 5905 - RNA, 62 nt, Human
ucccaguauucucagagcaugugucagaguguuguuccguuaaccuuuuuguaaauacugcu

SEQ ID NO: 5906 - RNA, 62 nt, Human
ucccagugauugaccaggcuuuaguggaagcccuuguuuacagaagagagggguaaaccuau

SEQ ID NO: 5907 - RNA, 61 nt, Human
ucccaucauaacugguggggcacaucuaacucaacugugaaaagacacaucacacaaucac

SEQ ID NO: 5908 - RNA, 63 nt, Human
ucccaucccggcagacccuuaucguugguguuuuccaguauuacaagaucaacuucugacccu

SEQ ID NO: 5909 - RNA, 62 nt, Human
ucccaugcccagucuucaaauuucuaauguuuugcaguguuaaaauguuuugcaaauacaug

SEQ ID NO: 5910 - RNA, 62 nt, Human
ucccaugggggcuccagacauuguauuuuacuuugugcaauaugaggggacugcaugcaagc

SEQ ID NO: 5911 - RNA, 63 nt, Human
ucccauuuaugaagguuccagcuucaaaugccaucacacuggagauuagauuuucaacaugug

SEQ ID NO: 5912 - RNA, 59 nt, Human
uccccagcugacccugugaggcccaagcaggccugcugaacucagaggagaaagccuga

SEQ ID NO: 5913 - RNA, 62 nt, Human
uccccaucuggaaaaugggggcagggguccugaccuaccucagguggaacggugagcaggga

SEQ ID NO: 5914 - RNA, 61 nt, Human
uccccccagguacgauagggacugaauauggacccugcugaaagcaguguauugacgcaua

SEQ ID NO: 5915 - RNA, 64 nt, Human
uccccccgcauuuugcugcauaugccuuuaaaaucaaugcaguauuaccauuaaaacaugggac

SEQ ID NO: 5916 - RNA, 63 nt, Human
ucccccgcaaugugggcacuuaccauguuccuggcacacuggaccucaccaugucccccgguc

SEQ ID NO: 5917 - RNA, 62 nt, Human
ucccccuuuccacugggcccuuccaacacaaugaaugaaggaaauaucauuuauuuaagcag

SEQ ID NO: 5918 - RNA, 64 nt, Human
uccccuaaacaacuucugccaaacaauaauaaagccaacuggaaacgaaucggagccauuuuca

SEQ ID NO: 5919 - RNA, 62 nt, Human
uccccuccaaaucucauguucaaagugugacauucaguguuagaggugggccuaguaggagg

SEQ ID NO: 5920 - RNA, 62 nt, Human
uccccuccucgugccugcccugccucuccacgcacaguguuaaggagccaagaggagccacu

SEQ ID NO: 5921 - RNA, 63 nt, Human
uccccucugagcauauuucuaugcugcugcuucuugugacuuacaugaggcaucucagcuucu

SEQ ID NO: 5922 - RNA, 62 nt, Human
uccccuggcaaacauugucaccaaggugggauguugcugcuaaugggagagucaucauaaaa

SEQ ID NO: 5923 - RNA, 64 nt, Human
ucccgccggcagcugugcgcaccaaagacucgggagaacuggaaaggcugucuggggucuucug

SEQ ID NO: 5924 - RNA, 61 nt, Human
ucccgccuucaccagacucaaggacacccuggcccugcugaggcauacagagcuucagccc

SEQ ID NO: 5925 - RNA, 62 nt, Human
ucccuaacggggaagugacgggguuuugucucuaucaucucaggcgucaaccacaugcacac

SEQ ID NO: 5926 - RNA, 62 nt, Human
ucccuaucaguucuagcauaguaaacuacgguaccaguguuagugggaagagcuggguuuuc

SEQ ID NO: 5927 - RNA, 62 nt, Human
ucccuccacacuuccacuuuguccuccucguccccuaccucaacaaagcagggugggguagg

SEQ ID NO: 5928 - RNA, 61 nt, Human
ucccucucucuagggucuccuguagggcuuaugacugugaauccuugaugucaugauuuua

SEQ ID NO: 5929 - RNA, 62 nt, Human
ucccucucucuuucccuuuggcagcugcaauacacaguguuauucuggggaaauaaaucuag

SEQ ID NO: 5930 - RNA, 64 nt, Human
ucccucugcacccccaccaccuccugcccgucuggcaacuggaaagagggaguuggccugauuu

SEQ ID NO: 5931 - RNA, 61 nt, Human
ucccugugcucgacagcaaagucuugacuccuuccugcugagcacugugcuaccuucacug

SEQ ID NO: 5932 - RNA, 62 nt, Human
ucccuuaacuagcuuuuucuuuaaauacucguuaauaagcuauuccacaaaccuccaguuaa

SEQ ID NO: 5933 - RNA, 64 nt, Human
ucccuugaagcaagaaagagggucccagggcugcaaaacuggaagcacagccucggggaugggg

SEQ ID NO: 5934 - RNA, 64 nt, Human
ucccuugcagcuagcaagguugugugacuaagcccuggccaguaggcauggaagugaagacugu

SEQ ID NO: 5935 - RNA, 63 nt, Human
ucccuugcccuguuuuucccucuuccagcugaccugugacuuauacugcucuuaccgaugaua

SEQ ID NO: 5936 - RNA, 63 nt, Human
ucccuuggggaaggguggggagaaauauaggauagacacuggacauggcccauuggagcaccu

SEQ ID NO: 5937 - RNA, 62 nt, Human
uccgaggaauggagcugacuuugacaucacagggaugaaggagcuacuugagggucuggacu

SEQ ID NO: 5938 - RNA, 62 nt, Human
uccgcucucccucuccugcugcccacccaccugccaguguuauuuaugcucccuucgugggu

SEQ ID NO: 5939 - RNA, 64 nt, Human
uccguacuaaccgucugcaaaccccaagacguuugaggccaguaggaaguugagaaagaaagcc

SEQ ID NO: 5940 - RNA, 63 nt, Human
uccgucauggggagggucccugcucaguucuggagacacuggaguuggggugggggugguucu

SEQ ID NO: 5941 - RNA, 62 nt, Human
uccgugccagaagcaagccugugagauacagaaauguuuacaagccaacagcuacauggaau

SEQ ID NO: 5942 - RNA, 61 nt, Human
uccguggagcuugcgaggcagcguggacuggugacugugaaggaaggcccccgugguagaa

SEQ ID NO: 5943 - RNA, 63 nt, Human
uccgugggguagaugcaauaagcccacguauuuuuacacuggaaacguugauuguuuuaaaug

SEQ ID NO: 5944 - RNA, 61 nt, Human
uccuaaccuuaccuuagaugcuaacagaaggguccugcugaaauaacacugggugcuauau

SEQ ID NO: 5945 - RNA, 64 nt, Human
uccuaagagauaaugcucuguacuucauuugaaauaaacuggaauuguauuagauagcucaggc

SEQ ID NO: 5946 - RNA, 62 nt, Human
uccuauuuuuuauggauuuuucagcucauuucagaugaaggaacuaagucauugugaacugu

SEQ ID NO: 5947 - RNA, 62 nt, Human
uccucaccagaaccuaaccaugcuggugauauccucaucucagacuucuaaccuccagaacu

SEQ ID NO: 5948 - RNA, 61 nt, Human
uccucacuucugaguuucauccuauccgagggaugagauuaaggcagaggcaaaaguuuca

SEQ ID NO: 5949 - RNA, 62 nt, Human
uccucagauugcugaaucccaucaggcuguuauuaugaaggaauuugauugcuuugcugcac

SEQ ID NO: 5950 - RNA, 62 nt, Human
uccuccacggguggaccaggauggagucuccugccuaccucacugcauugcacuggaccugg

SEQ ID NO: 5951 - RNA, 62 nt, Human
uccuccagcuguaaccauggauaccacacauuucucaucucauuggcccccaccccagagac

SEQ ID NO: 5952 - RNA, 61 nt, Human
uccuccaggugucuuacuucagaaugcauccuuugagauuauguccacuuaagagaaauca

SEQ ID NO: 5953 - RNA, 63 nt, Human
uccucguagcgucugcuccucacuuuguguugauggugacuuaggagaauguuccgauuuucc

SEQ ID NO: 5954 - RNA, 61 nt, Human
uccucucuucuucaagucccccuuguggcggggacugugaaccgaggcagugaggugauug

SEQ ID NO: 5955 - RNA, 62 nt, Human
uccucucuuuguaccacaguuucuucuguaaauccaguguuacaaucagugugaauggcaaa

SEQ ID NO: 5956 - RNA, 63 nt, Human
uccucugcugaagccuuaccuccuucucacccaguaacgguuaacucuucucuuguguauaug

SEQ ID NO: 5957 - RNA, 62 nt, Human
uccucuguaaaacggggacagucccugccccucccuaccucacaggcauguugugagaauaa

SEQ ID NO: 5958 - RNA, 62 nt, Human
uccucuguuuucuuuuuaauauacauuuaaaauacaguauuaucacuuuauaaaacauacau

SEQ ID NO: 5959 - RNA, 61 nt, Human
uccucuuuuccuuuucccagacucagacgaugcccugcugaagaugaccaucagccagcaa

SEQ ID NO: 5960 - RNA, 63 nt, Human
uccugaacaaugaauucccauuaaugagcagucuucaguauuaaaaccacugucuugucaccu

SEQ ID NO: 5961 - RNA, 61 nt, Human
uccugaccugcccaccucaaccucccaaagugcugagauuacaggcgugagccaccacacc

SEQ ID NO: 5962 - RNA, 64 nt, Human
uccugagaggcaguggccucuugagugaacaggggaggccaguagaugccccagauccagagcc

SEQ ID NO: 5963 - RNA, 61 nt, Human
uccugauccgcccaccucagccucccaaagugcugagauuacaggcauaagccaccgcgcc

SEQ ID NO: 5964 - RNA, 62 nt, Human
uccugcacgaggguguugggaggacaccacagauucaucucagacagugaucaggacugagg

SEQ ID NO: 5965 - RNA, 62 nt, Human
uccugccuguugacagccacuagaggcccagccucuaccucaacagugugcccuccaggccc

SEQ ID NO: 5966 - RNA, 62 nt, Human
uccugcuaauguguaaaauacauacuugcccuggcuaccucaccgggcuguuauugcuggaa

SEQ ID NO: 5967 - RNA, 61 nt, Human
uccuggagggcgcccagcagccugccagcaguuacugugaauguuccccaccgcugagagg

SEQ ID NO: 5968 - RNA, 61 nt, Human
uccuggcucccaacagcuucucaguucccacuuccugcugagcucuucuggacucaggauc

SEQ ID NO: 5969 - RNA, 63 nt, Human
uccugggugaugcugauggggucagucuaugaaccacacuggagcaaccagguucuaggacuu

SEQ ID NO: 5970 - RNA, 63 nt, Human
uccugguagcuggaggaaccgauuucagggaguagacacuggagacaauacugacuccaggca

SEQ ID NO: 5971 - RNA, 64 nt, Human
uccuguacuuacuaggcaaaacguaugaaucggauuaacuggaaaauauaucugaauucaacug

SEQ ID NO: 5972 - RNA, 62 nt, Human
uccugucugacgaugcucugcaguuguggucugucuaccucagaagagacuguauuuuaaaa

SEQ ID NO: 5973 - RNA, 62 nt, Human
uccugugaccugucagggcugacuucaccucugcucaucucaguuuccuaaucuguaaaaug

SEQ ID NO: 5974 - RNA, 62 nt, Human
uccuguuggucucucuguguucuuuguuacuugggugcaauagcaacuucccuaccccgugc

SEQ ID NO: 5975 - RNA, 62 nt, Human
uccuguuuagcucuuaauguaucuaaggauguucucaucucaccauucuacucauuuaguga

SEQ ID NO: 5976 - RNA, 63 nt, Human
uccuuaugcaugaaaugaaugucugagauacgucugugacuuaucuaccauugaaggaaagcu

SEQ ID NO: 5977 - RNA, 62 nt, Human
uccuucagaccccuaacccuacuaaccagcaggcucaucucaccuccaggccugaaacauuu

SEQ ID NO: 5978 - RNA, 64 nt, Human
uccuucucaggaaccuagaaacaacaccgcuugagcaacuggaauauguuugcugcaagcagaa

SEQ ID NO: 5979 - RNA, 62 nt, Human
uccuugcucugaaaauugguaaaucaagcauguuuguuuacauuaaaaaguccagacacacu

SEQ ID NO: 5980 - RNA, 62 nt, Human
uccuugcugggguuucuacaguccccaacgugaacaguauuaagcaagagguggacucgagc

SEQ ID NO: 5981 - RNA, 62 nt, Human
uccuuggucucacagccauguagacaagcccuggucaucucagcagccaccgcacaacaccc

SEQ ID NO: 5982 - RNA, 61 nt, Human
uccuuuaguuugcuucuguaagcaacgggaacaccugcugagggggcucuuucccucaugu

SEQ ID NO: 5983 - RNA, 62 nt, Human
uccuuuccauacccagucucaccuucuccccacccuaccucaccucuucucaggcaccccuc

SEQ ID NO: 5984 - RNA, 62 nt, Human
uccuuuccuggcugugacccgccacacucacugucaguauuaaggcccagcagccuguugau

SEQ ID NO: 5985 - RNA, 62 nt, Human
uccuuuugaagcucuuuugaauguugaauuguucauaagcuaaaauccaagaaauuucagcu

SEQ ID NO: 5986 - RNA, 62 nt, Human
uccuuuugccguaauggaugcaguggaauaacaauguuuacagguaccgaucccgaucccug

SEQ ID NO: 5987 - RNA, 61 nt, Human
ucgacuucggggcccagggaccaaccugcauggacugugaaaccucacccuucuggagcac

SEQ ID NO: 5988 - RNA, 51 nt, Human
ucgagacacccgaucgugaaagaccugcugagccagccuguucuccgggcc

SEQ ID NO: 5989 - RNA, 61 nt, Human
ucgagggauccacccauuggccuccaaaagugcugagauuacaggcaugaaccaauguuac

SEQ ID NO: 5990 - RNA, 62 nt, Human
ucgaggguucaugcagucaguguuauaccaaacccaguguuaggagaaaggacacagcguaa

SEQ ID NO: 5991 - RNA, 62 nt, Human
ucgaugguuucuucuauacaccuuuuugguugaccaguauuacuauacaauguaaguguuuu

SEQ ID NO: 5992 - RNA, 61 nt, Human
ucgcacauugguauaauugauuugugguagagcugagauuagaauccagauuccuagucua

SEQ ID NO: 5993 - RNA, 62 nt, Human
ucgcacggccuuggagcaggaggugggucuggcaugcugcuaugucucaaaagaggucaucc

SEQ ID NO: 5994 - RNA, 63 nt, Human
ucgccaauuaguuguaauaaacguucaacguacaaacacuggaguguguuuuuaucucuuucc

SEQ ID NO: 5995 - RNA, 62 nt, Human
ucgccuuugcagaaccaccugggccccuuucugucaguauuauuaggguuacgaauugcagc

SEQ ID NO: 5996 - RNA, 63 nt, Human
ucgcuccacuuuacagagguagcugugguguugaaacacuggacuuggauauggggugcuggg

SEQ ID NO: 5997 - RNA, 62 nt, Human
ucggacuuggaauagaucccaguugccugauaauucaucucauuauugccucuaaagcaaau

SEQ ID NO: 5998 - RNA, 62 nt, Human
ucggagaagugagaggcucucccuggcuagauccucaucucaauagcaccuccucccuuuuc

SEQ ID NO: 5999 - RNA, 63 nt, Human
ucgggagaccccaacucccccugaacaauccuuuucaguauuauauuuuuauuauuauuaugu

SEQ ID NO: 6000 - RNA, 62 nt, Human
ucgggauuaguacacacuuguugauuaauggaaauguuuacagauccccaagccuggcaagg

SEQ ID NO: 6001 - RNA, 62 nt, Human
ucggugagggugcaguugcuaugauuguaauuggucaucucaucauggcuguuaacauuucu

SEQ ID NO: 6002 - RNA, 62 nt, Human
ucguaaucucaagguuauuauucugacaccagcuugcugcuaugauuucagagcacauaagu

SEQ ID NO: 6003 - RNA, 62 nt, Human
ucguaggauguauacagacuuauuuucuuuauuacaguauuauaagaaaacauauguauuug

SEQ ID NO: 6004 - RNA, 62 nt, Human
ucgucaaaaggaagggauugguuuggcaagaacuuguuuacaacauuuuugcaaaucuaaag

SEQ ID NO: 6005 - RNA, 62 nt, Human
ucgucaaugugaauagcuuagaauacugcaaaggauaagcuaauugaaugccuugaaaguau

SEQ ID NO: 6006 - RNA, 61 nt, Human
ucgugauccacccaccucgaccucccaaagugcugagauuacaggcgugagccaccgcgcc

SEQ ID NO: 6007 - RNA, 61 nt, Human
ucgugauccaccugcuucggccucccaaagugcugagauuacagguguaagccacugagcc

SEQ ID NO: 6008 - RNA, 64 nt, Human
ucguguuuuucuuacuauuuuuuaauacauaguuuuaugcaguaaguauugcaauagaauccug

SEQ ID NO: 6009 - RNA, 62 nt, Human
ucuaaaaaggugaaacuuuggcuguugaaaguuucaguauuaguaaacuugaguuacuuuuu

SEQ ID NO: 6010 - RNA, 59 nt, Human
ucuaaaccagcgucggugaggaggaagggguauaagcuacaaugccuagaagagaauga

SEQ ID NO: 6011 - RNA, 62 nt, Human
ucuaaaggagaugcaggauguucagggagccuugcaguguuauacgcgugccauccaaauua

SEQ ID NO: 6012 - RNA, 62 nt, Human
ucuaaagugcucuuaugagagacuugugggccaucaguauuagugauuucauacugcagugc

SEQ ID NO: 6013 - RNA, 63 nt, Human
ucuaaaugauacauuggaauugugccuuuucuaccacacuggauuaaauaaacuugucaaaau

SEQ ID NO: 6014 - RNA, 62 nt, Human
ucuaagagaauccuuugugucagugaagcuggagcuaccucauucuuuuaacuggcugcgug

SEQ ID NO: 6015 - RNA, 64 nt, Human
ucuaaguauauuccuauuguacuaaauauuuuucccaacuggaaagcacuugauuguacccgua

SEQ ID NO: 6016 - RNA, 63 nt, Human
ucuaauaagaugcuuuucuuagauugaauauuccugugacuuaaaauaaguagcuuaaaaaug

SEQ ID NO: 6017 - RNA, 64 nt, Human
ucuaauaauuaaaaauaaaaauaauacuugggagguaacuggaauaaagguucuaaaaucaaaa

SEQ ID NO: 6018 - RNA, 64 nt, Human
ucuaauguauaugaucuaacaaaaaugaaacaugaaaugcaguagcaaccacuaaaaaaaaaaa

SEQ ID NO: 6019 - RNA, 62 nt, Human
ucuacaagugugccacaucaauccgguaaugccccaguguuauucacagacagaacuuuguu

SEQ ID NO: 6020 - RNA, 62 nt, Human
ucuacacagcaagagaacagaaauacugugucucaugaaggaucacagaguucagggggaaa

SEQ ID NO: 6021 - RNA, 62 nt, Human
ucuaccuucaacaugugcucgcucugcaugauuagugcaauaaaacucccuuccuuaugcau

SEQ ID NO: 6022 - RNA, 62 nt, Human
ucuacuaacaacuccuuuuuuucucuagagaguuaugaaggaacagguuguccuugucugga

SEQ ID NO: 6023 - RNA, 62 nt, Human
ucuagacagcagaagaaaaccccucucucagcgcucaucucacgcagaggaugccaggcagg

SEQ ID NO: 6024 - RNA, 64 nt, Human
ucuagguagagacagauacaugagaagagccuccaaaacuggaagcccaucauaaggcaugaga

SEQ ID NO: 6025 - RNA, 62 nt, Human
ucuagguuaaguuugagccugaaauuuuaaugaagugcaauacugagugugccucauuaucu

SEQ ID NO: 6026 - RNA, 61 nt, Human
ucuaguguuuuugccgaagauuaccgcuggccuacugugaagggagaugaccugugauuag

SEQ ID NO: 6027 - RNA, 61 nt, Human
ucuaugcaugcuauuaccgccuuauggcuguggugagauuaaaacaugauacugugguuug

SEQ ID NO: 6028 - RNA, 62 nt, Human
ucuauguguauagguaucuguauaucuuuccuuuuguuuacaacuguuaaaaaaccucaaaa

SEQ ID NO: 6029 - RNA, 64 nt, Human
ucuauuauuuugaguuauacuguuuucaaagucauuaugcaguauguauaaacuuauaagaauu

SEQ ID NO: 6030 - RNA, 62 nt, Human
ucuauuuuccucugcauuguacuaaucuguuacucaguguuagucuucauuuuucuguguug

SEQ ID NO: 6031 - RNA, 62 nt, Human
ucuauuuuuuuguuuguuucuuguuuuuuaauaauguuuacaaucugccucaaucacucugu

SEQ ID NO: 6032 - RNA, 63 nt, Human
ucucaaacucuccaguguggugugaacucagaagaaacgguuacuggggcugcauggagaauu

SEQ ID NO: 6033 - RNA, 62 nt, Human
ucucaaccuauuaguugcagucagagggaccuacuguuuacacaggccuuuuuagucaugcc

SEQ ID NO: 6034 - RNA, 61 nt, Human
ucucaagaugggggcagggcugugcuugaaggcccugcugagucaucuguuagggccuugg

SEQ ID NO: 6035 - RNA, 62 nt, Human
ucucaaguaaccuaucaaauauuguaaaugcaauugcugcuaguucaguuacauuucugcug

SEQ ID NO: 6036 - RNA, 63 nt, Human
ucucaaguguuuccuagacagagaggcaccugggucaguauuagucuauuuaucagaggugua

SEQ ID NO: 6037 - RNA, 63 nt, Human
ucucacagaagaaggaaauugaauuuccaugaguuacacuggaugaaaauguucccuucaagu

SEQ ID NO: 6038 - RNA, 64 nt, Human
ucucacccacauucgcugaagcgauggagagucgggggccaguagccagccaaccccgugggga

SEQ ID NO: 6039 - RNA, 62 nt, Human
ucucacuuauagagcucuccaggacuggaaaaagugcugcuauuuuaacuugcucuugcuug

SEQ ID NO: 6040 - RNA, 61 nt, Human
ucucagcaauaggaguagcgacccagguggagcugagauuaggccucuggggaucaccaga

SEQ ID NO: 6041 - RNA, 61 nt, Human
ucucagcuucagaacauucacuuauaaagaaacccugcugauuaaaucucucuugggcuuc

SEQ ID NO: 6042 - RNA, 62 nt, Human
ucucaggaccccguggaauugcaucuucugcaggaugaaggagucuccgggaagccaacagu

SEQ ID NO: 6043 - RNA, 62 nt, Human
ucucaggagacagugaggcugccccuccuaccaccuaccucauucugccuacucaccccagg

SEQ ID NO: 6044 - RNA, 61 nt, Human
ucucaggcggggaucacgauccuuguagacgcaccugcugagaauccccgugcucacagua

SEQ ID NO: 6045 - RNA, 63 nt, Human
ucucaguauauucguucucaugaagacacagucagacacuggacaauguaauguaugcaacug

SEQ ID NO: 6046 - RNA, 62 nt, Human
ucucaguauugccccuuccuuucacuuucacacuucaucucauuccuguugucacuuucccc

SEQ ID NO: 6047 - RNA, 64 nt, Human
ucucaguuuacuucuaaguaaucacagauaauacauggccaguaaucccaggcuggccauucau

SEQ ID NO: 6048 - RNA, 62 nt, Human
ucucaguuuugguauuuuguguuuuuguuuucauucaucucaaaguauuuucuaauuucccu

SEQ ID NO: 6049 - RNA, 62 nt, Human
ucucauaguguaaacucacauuugauguguuuuuaugaaggaaaguaaccaagaaaccucua

SEQ ID NO: 6050 - RNA, 63 nt, Human
ucucaucagauggguuuuauuuaacccuguauauugugacuuacuuucuaaucugacucuggc

SEQ ID NO: 6051 - RNA, 62 nt, Human
ucucaucuuuuaauuucuuuaacuuauuucaaaaucaucucaugacccuugugugccucuuu

SEQ ID NO: 6052 - RNA, 64 nt, Human
ucucauggaagaauccuuuacacaugaaaacaauggaacuggaaaaucuugucuuuuagaaaag

SEQ ID NO: 6053 - RNA, 62 nt, Human
ucucauguagaacaagaaaucuuucuggaauugauguuuacaugucuguuguuggucaucuc

SEQ ID NO: 6054 - RNA, 62 nt, Human
ucuccaaaccuuuuuuguuuuguuuuguuuccgauguuuacacauguugccugagcugguua

SEQ ID NO: 6055 - RNA, 62 nt, Human
ucuccaaauaaaaaggguuuuguucagauuaaaauguuuacaacaaaauguuaauuauauuc

SEQ ID NO: 6056 - RNA, 61 nt, Human
ucuccacauaaggauaaccuuacgugaaaccuuccugcugacaaccaugcagaggaauuuu

SEQ ID NO: 6057 - RNA, 64 nt, Human
ucucccaguaauuauacaauauuuaauauuuacuuaaacuggaacaagaauaagauaaacauuu

SEQ ID NO: 6058 - RNA, 63 nt, Human
ucuccccggccuccucugucugcacccguggggcugugacuuacuccugccuccaggggcggg

SEQ ID NO: 6059 - RNA, 62 nt, Human
ucuccugaugcauuuguaaacaagaagguuucagcaguauuacaccaccucccucaugccuc

SEQ ID NO: 6060 - RNA, 63 nt, Human
ucuccugcauaggcagccacuguccguucuuucacacacuggaaggaagagccaucguggucu

SEQ ID NO: 6061 - RNA, 62 nt, Human
ucucgaacuccugaccucaggaaccuggagaccaucaucucauuuccugggggagagagccu

SEQ ID NO: 6062 - RNA, 62 nt, Human
ucucgcccugaguacucuucuugggaguugcugcuguuuacagccacagucucaucuaucac

SEQ ID NO: 6063 - RNA, 62 nt, Human
ucucuagcugcaaaauggggauaauacuauauaccuaccucacagugggagggcaggagauu

SEQ ID NO: 6064 - RNA, 62 nt, Human
ucucucacauuauauaguagauguuuguuuauaauguuuacaaaacauuuuggugaauuucc

SEQ ID NO: 6065 - RNA, 62 nt, Human
ucucuccucuauguacccccugcccaccucgggccuaccucagcccucaccccucugccugc

SEQ ID NO: 6066 - RNA, 63 nt, Human
ucucucuagucugaauggcuucauuguuucuuucucaguauuagaaauuauaguuacaaugaa

SEQ ID NO: 6067 - RNA, 64 nt, Human
ucucucuucacuuuaucauugcccaagaaugaggauaugcaguaaacagaauucaggcaagaua

SEQ ID NO: 6068 - RNA, 63 nt, Human
ucucugaggaucaccugcugucaaauugccaucuacaguauuacagcuuugcauuuggggguu

SEQ ID NO: 6069 - RNA, 63 nt, Human
ucucuggacugggagcucagugaggauucugaccagugacuuacacaaaaggcgcucuauaca

SEQ ID NO: 6070 - RNA, 62 nt, Human
ucucuggcuuguuuuuuuguuuuucccagaaaaucaguauuauuuuuuaaauaagaaaaaca

SEQ ID NO: 6071 - RNA, 62 nt, Human
ucucugggguaagaguaaaggcuuccagaagacaugcugcuauggucacugagggguuagcu

SEQ ID NO: 6072 - RNA, 62 nt, Human
ucucuguucggagacaugagaaguaugauuacuucaguguuaguuuucuuaauuuuuuuuuu

SEQ ID NO: 6073 - RNA, 62 nt, Human
ucucuuacacuuggggguagcggggucaggacaaucaucucaguccugcaucuuuucuucug

SEQ ID NO: 6074 - RNA, 62 nt, Human
ucucuucaccaugagacuggcuuuccacaaacucucaucucaggcccuccccuugugccuga

SEQ ID NO: 6075 - RNA, 63 nt, Human
ucucuuccuggauagcccaaaguguccgccuaccaacacuggagccgcugggagucacuggcu

SEQ ID NO: 6076 - RNA, 63 nt, Human
ucucuugaacuuuugguauaguaagguaacucuaacaguauuacugucuuuuucagcaauaac

SEQ ID NO: 6077 - RNA, 62 nt, Human
ucucuuucuuuugugcauauggcaacguucauguucaucucagguggcauuugcaggugacc

SEQ ID NO: 6078 - RNA, 63 nt, Human
ucucuuuuuuuggcccaggccuugaagaauacacugugacuuaagaagccuuaccacgcagua

SEQ ID NO: 6079 - RNA, 61 nt, Human
ucugaaaacagaagacagucuuaauauaaauguacugugaagaaugcuauugauguuuaug

SEQ ID NO: 6080 - RNA, 62 nt, Human
ucugaaccuugggagagggcugaacucuacgccguguuuacagaauguuugcgcagcuucgc

SEQ ID NO: 6081 - RNA, 62 nt, Human
ucugaaggguauguugcaugcauuuuuaaaaaaaucaucucauaugcauuguauaguuuggg

SEQ ID NO: 6082 - RNA, 62 nt, Human
ucugaaguucccccauuuccuucaguaccagucuauaagcuacuguccgccacugauuuuca

SEQ ID NO: 6083 - RNA, 61 nt, Human
ucugacauuguaaagagauccaacagaaucacuccugcugaaaaauacgcuuucugccacc

SEQ ID NO: 6084 - RNA, 62 nt, Human
ucugacuguugcagaacuguucgagcuccuaauucaguguuaccuuguuuuagucgcagcaa

SEQ ID NO: 6085 - RNA, 62 nt, Human
ucugagaagcagcuuuaugagguuuuacagaguaugcugcuaccucucuccuugaagggagc

SEQ ID NO: 6086 - RNA, 62 nt, Human
ucugagauugucagcccuuugucuaaaauaauggcaguauuaaugauugacuucugucacug

SEQ ID NO: 6087 - RNA, 62 nt, Human
ucugagggcgauuucggaaauguuuucagcagaaaugaaggauaagcaucgcacauguccag

SEQ ID NO: 6088 - RNA, 63 nt, Human
ucugaugaguuaaaaaaggucccagagauauauagacacuggaguacuggaaauugaaaaacg

SEQ ID NO: 6089 - RNA, 62 nt, Human
ucugauggucuuuugaccugaugcugccauacugcaguguuaccagcucccccuagaaaacg

SEQ ID NO: 6090 - RNA, 62 nt, Human
ucugcacagacaagacacucaguguccuuggcagugcugcuacuccucaggugcagcauaca

SEQ ID NO: 6091 - RNA, 62 nt, Human
ucugcacuuugcugcgaaaagcaaagggccuucuaugaaggacaaaacuugcagaauugggu

SEQ ID NO: 6092 - RNA, 62 nt, Human
ucugcagccgacuuagacaugcucuucccuuucuauaagcuagauuuuagaauaaaggguuu

SEQ ID NO: 6093 - RNA, 64 nt, Human
ucugcaguuuugacauuuaggauuuugugucuuuuaaacuggaaaaucuucuagcauguugggu

SEQ ID NO: 6094 - RNA, 62 nt, Human
ucugccacccuaggcuuccaaauuauacuuaaauuguuuacauagcuuaccacaauaggagu

SEQ ID NO: 6095 - RNA, 62 nt, Human
ucugccagccaacccccacuugcccaagucacuggugcaauaacuuuucugccuuccucaga

SEQ ID NO: 6096 - RNA, 62 nt, Human
ucugcccuugaagguaucuucuccaggaaauuagcaguauuauuuucacuucuaagcaaaca

SEQ ID NO: 6097 - RNA, 59 nt, Human
ucugccggugucugagugaaaggaccgcgcuccugcugaagaguuuagaaugaggcagc

SEQ ID NO: 6098 - RNA, 62 nt, Human
ucugcgcucuucccucaaaacucuuuuugugaaaugcugcuaccaguuuacuaacaaaauug

SEQ ID NO: 6099 - RNA, 61 nt, Human
ucugcucccuggggcauauggacugacccaccuccugcugagaaccuuccccuaggcccug

SEQ ID NO: 6100 - RNA, 62 nt, Human
ucugcuggggcugacuuguccagaaggggacaaagugcaauacagagccuucccuacccuga

SEQ ID NO: 6101 - RNA, 63 nt, Human
ucugcugugaagaugaaaauaaaaauggagagaaaacacuggaaaacuauuuuccccuccuau

SEQ ID NO: 6102 - RNA, 62 nt, Human
ucugcuguucucacacuuaaacucuguuuuauuuauaagcuaaauggaaaggaaacaccuuu

SEQ ID NO: 6103 - RNA, 51 nt, Human
ucuggaaacagaugucuaguugaucaucucagcugaaguguggcuugcgua

SEQ ID NO: 6104 - RNA, 61 nt, Human
ucuggaguauaagugggaaagcuugauuuaaauacugugaacucuaauaauguggaaaaua

SEQ ID NO: 6105 - RNA, 64 nt, Human
ucuggauauuacuagaguuguaaaacacaacuuggaaacuggaauuuaugugaagaaccaaaca

SEQ ID NO: 6106 - RNA, 61 nt, Human
ucuggccauccaucaaguccaucaaggcccagcccugcugagaaaugugcuucugcuucua

SEQ ID NO: 6107 - RNA, 62 nt, Human
ucuggccuguggcucacugcaugcagccccuggcgugcaauacuagugcuccacggcgcgau

SEQ ID NO: 6108 - RNA, 62 nt, Human
ucugggccccucacuguggggauugaucauucucaugaaggaaucacaguuauauggcaacu

SEQ ID NO: 6109 - RNA, 61 nt, Human
ucugggcucaaguauccugccacucugucauguccugcugauggaaggugccccuguuccc

SEQ ID NO: 6110 - RNA, 62 nt, Human
ucuggggauuuuuuuccagccgaaggaaaaucacuuccguuaugucccccucuaauuuagcc

SEQ ID NO: 6111 - RNA, 62 nt, Human
ucugggggccaaaggucaguggcaggggguauuucaguauuauacaacugcugugaccagac

SEQ ID NO: 6112 - RNA, 62 nt, Human
ucugggggcccgacaggugggccugggaggaagauguuuacauuuuuaaagguacacuggua

SEQ ID NO: 6113 - RNA, 64 nt, Human
ucugggguucuuaauuuggaagaauacaugcaugagaugcaguagguccugagacuguaagaua

SEQ ID NO: 6114 - RNA, 62 nt, Human
ucugguagugauguauauuuuacauuugucauuucaguguuacuggaguuuucuucauugug

SEQ ID NO: 6115 - RNA, 63 nt, Human
ucuguaaaaaagaagaugcugccaaugagccauugacacuggagaaugauacguacccugaaa

SEQ ID NO: 6116 - RNA, 62 nt, Human
ucuguacaaaugggaacauuacccccugcccugccuaccucacagggcuguugugaggaauu

SEQ ID NO: 6117 - RNA, 62 nt, Human
ucuguagugcuauuauagugaaaaacucaguucuauaagcuagcuguguugucacaguuuua

SEQ ID NO: 6118 - RNA, 63 nt, Human
ucuguccaucuccaucucuuauauauaacaauacugugacuuaaaaaccaacucaguauugga

SEQ ID NO: 6119 - RNA, 62 nt, Human
ucuguccuuaaggaaugguccucugggagggcugugcugcuaguggguaccucagucacaca

SEQ ID NO: 6120 - RNA, 62 nt, Human
ucugucuccagucucuggaggugaagcagggacaauaagcuaagguaguaucuuggccaucc

SEQ ID NO: 6121 - RNA, 62 nt, Human
ucugucuuuguaacuacucaaggccaacugucacaugaaggaaugaauaaagaguuuuuacu

SEQ ID NO: 6122 - RNA, 62 nt, Human
ucugugacagagcugcagaccccugccuugagucucaucucagcaaugcugccacccucuug

SEQ ID NO: 6123 - RNA, 64 nt, Human
ucuguggagguugcugguacacaccaaaugaguccaaacuggaaugagcagcuuuagcaaagaa

SEQ ID NO: 6124 - RNA, 62 nt, Human
ucugugggcacuggugggccauuagauuuggaggcuaccucaccugggcagggaugauggca

SEQ ID NO: 6125 - RNA, 61 nt, Human
ucugugugcauuuuauggaaagaaaguugggucugagauuauauuguaauuuuauacuuuc

SEQ ID NO: 6126 - RNA, 64 nt, Human
ucuguguguguagugagaguguguagccacuauuauaacuggaauuuaauuuacauucauaaac

SEQ ID NO: 6127 - RNA, 61 nt, Human
ucuguguugcuucaaauuggucugaaaggcuauccugcugaaaguccugcuuuccuaucua

SEQ ID NO: 6128 - RNA, 62 nt, Human
ucuguuaaguuauguuuacaguaucuuguaucgcuguuuacaaaucuugcauggacuccugc

SEQ ID NO: 6129 - RNA, 62 nt, Human
ucuguuacuucccuucuaugaagguagaagcuuucaguguuacaacuucugauggcggaaaa

SEQ ID NO: 6130 - RNA, 62 nt, Human
ucuguuccauggugugcaggucugcuucuuaauucaguguuaugauaucuuccaguuuuugc

SEQ ID NO: 6131 - RNA, 62 nt, Human
ucuguugaaaccaacuuugauaggguccucaccuuuccguuaaggaggugccgcacuacaag

SEQ ID NO: 6132 - RNA, 64 nt, Human
ucuguugggcuaucugagguccugcuaccauuccuuggccaguaauagguaguuucacagggau

SEQ ID NO: 6133 - RNA, 62 nt, Human
ucuguuuaaacauuauucugaagugucuugaguguguuuacagacaagauuugcauuugaac

SEQ ID NO: 6134 - RNA, 62 nt, Human
ucuguuucagaauuguaaaaaguacaucuagauguguuuacagaaagcaaguauccaguaug

SEQ ID NO: 6135 - RNA, 61 nt, Human
ucuguuuuaaugacaaggugauaugguagcaacacugugaagacaaucaugggauuuuacu

SEQ ID NO: 6136 - RNA, 63 nt, Human
ucuguuuuuucuguacacagaaguuuagaugcuuugugacuuaagcaggugugugggcuccuu

SEQ ID NO: 6137 - RNA, 61 nt, Human
ucuuaaaaacaagaaggcacacauuugagaagaugagauuaagguuaggagaaaaccucag

SEQ ID NO: 6138 - RNA, 64 nt, Human
ucuuaaaaacgcuuuagaauuuuuauguauguuaaaaugcaguauuguaaagugaauauauaua

SEQ ID NO: 6139 - RNA, 61 nt, Human
ucuuacacucuauccuuccuagaaaaugguaauugagauuacucagauauuaauuaaauac

SEQ ID NO: 6140 - RNA, 62 nt, Human
ucuuaccccgccguggcuuauggggaggaaugcaucaucucacuuuuuuuuuuuaagcagau

SEQ ID NO: 6141 - RNA, 63 nt, Human
ucuuaccgucaugucuugcaacaacccugugagggcaguauuaaugcccccuuacagcagaag

SEQ ID NO: 6142 - RNA, 62 nt, Human
ucuuacgaauguacaacacaaacuguaugaagccaugaaggaaacagaggggccaaagggug

SEQ ID NO: 6143 - RNA, 62 nt, Human
ucuuacugcuuuuaguaaaccuuuuaggcaagauucaucucagugaagugaacaaucauuuc

SEQ ID NO: 6144 - RNA, 63 nt, Human
ucuuacuucuuuuuaguuuuuauagcuuagcauuagugacuuauuucaaaagacccaaaucaa

SEQ ID NO: 6145 - RNA, 62 nt, Human
ucuuagagaucauuuuauaucaugacaaguagagcuaccucauucuuuuuaaugguuauaua

SEQ ID NO: 6146 - RNA, 62 nt, Human
ucuuagguauuccugcuccccugaagaaugauuacaguguuaacagaagacugacaagaguc

SEQ ID NO: 6147 - RNA, 62 nt, Human
ucuuagucccuaaucauguuucucccauaggcuguguuuacauggagcuaucgguuuagccu

SEQ ID NO: 6148 - RNA, 61 nt, Human
ucuuauccaccaacaagccauuaagguugguuuccugcugagacuuuuguaccggaagcga

SEQ ID NO: 6149 - RNA, 62 nt, Human
ucuuauuguugaauaaaaaagugcacagugugauuguuuacaaaaugauauuauaaauaaau

SEQ ID NO: 6150 - RNA, 62 nt, Human
ucuuauuucuuucagaagacauuucugaaaucuuauaagcuacuuaagcuacguugucaguu

SEQ ID NO: 6151 - RNA, 62 nt, Human
ucuuauuuugagcagcuuugggugguaaaguuauuguuuacaaauugaagcaacugauucua

SEQ ID NO: 6152 - RNA, 62 nt, Human
ucuucaaagggaagcaacuuggaugaacaggaacaugaaggacaacacaucucagccuuuuc

SEQ ID NO: 6153 - RNA, 62 nt, Human
ucuucaccuuuuccuguauuuguacauagugauucaguauuagagaaaagugcauuguuucu

SEQ ID NO: 6154 - RNA, 61 nt, Human
ucuucacuggaaaacagggaggggggauuucagacugugaagaaaguugaauggugguuuu

SEQ ID NO: 6155 - RNA, 63 nt, Human
ucuuccccgggcuucccuugauguuaacaucucaugugacuuauguuguacaauuauagaaac

SEQ ID NO: 6156 - RNA, 63 nt, Human
ucuucccuuucucuuuuggacaauaguuaaauuagcaguauuaguuaugaguuugguugcagu

SEQ ID NO: 6157 - RNA, 61 nt, Human
ucuuccuauacagucugcuuuaacucaggaccuugagauuaugagacugacgugcugccca

SEQ ID NO: 6158 - RNA, 61 nt, Human
ucuucucuaacagaugaccaauacuaauaaacuacugugaacuagaaaaaugcuacagaug

SEQ ID NO: 6159 - RNA, 62 nt, Human
ucuucucuucccucuaugagagaucugaaguacguguuuacaaaguaacuggcuucuacaau

SEQ ID NO: 6160 - RNA, 64 nt, Human
ucuucugacugugacccucuugaacugaaucagaccaacuggaaucccagaccgagucugcuuu

SEQ ID NO: 6161 - RNA, 64 nt, Human
ucuugaauguagacaauggaaggacagauucgagggggccaguauuguagacagggacaugcau

SEQ ID NO: 6162 - RNA, 61 nt, Human
ucuugauccacccgacuuggccucccgaagugaugagauuauaggcgugagccaccgcgcc

SEQ ID NO: 6163 - RNA, 62 nt, Human
ucuugaugaauucaucuggcauugcuuugccuuaucaucucaucuggaguuuuuaaaugcca

SEQ ID NO: 6164 - RNA, 62 nt, Human
ucuugccaaaauggauccuuugauuuuugucauuugcugcuaaaauauauuaucugaaggua

SEQ ID NO: 6165 - RNA, 62 nt, Human
ucuugccacccuuuccaaugcaucuucuacccugcuaccucagugauuauucuaaaauaaau

SEQ ID NO: 6166 - RNA, 61 nt, Human
ucuugccuucaaauaguguuuuacguuuuuuauccugcugaaaaaguauauauaaaauauc

SEQ ID NO: 6167 - RNA, 63 nt, Human
ucuugcugauuuucagacagggaagucucucuauuacacuggagcuguuuuauagauaaguca

SEQ ID NO: 6168 - RNA, 61 nt, Human
ucuuggaccucucuguucuucaagcaucgugucacugugaaauccuaacgccccugugucc

SEQ ID NO: 6169 - RNA, 62 nt, Human
ucuuggacuauguauuugacauguaaaauauguacaguauuaacgucaaccaucucuuuaaa

SEQ ID NO: 6170 - RNA, 62 nt, Human
ucuuguguaaauauauucaaggaaaacaccuccacuaccucacugacuucauaauuggaaug

SEQ ID NO: 6171 - RNA, 62 nt, Human
ucuuguucuucuuaaaugugacaugaaauaauugugcugcuacauuauacuggaaauuaaca

SEQ ID NO: 6172 - RNA, 62 nt, Human
ucuuguuuaggaaauggauguauaaaaaaaucaagugcaauaaaguguguguccaaaagcug

SEQ ID NO: 6173 - RNA, 64 nt, Human
ucuuguuucuucacaugcuggacuagcuuaagaccaaugcaguagcuuauuuccaagccuugca

SEQ ID NO: 6174 - RNA, 62 nt, Human
ucuuguuuuaauccuuuucaaaagaugguuuauaauaagcuauaugacuuuaacaggcacuc

SEQ ID NO: 6175 - RNA, 61 nt, Human
ucuuguuuuccagcugcuuuccugggggaucagacugugaagcaggaagacagauauaaua

SEQ ID NO: 6176 - RNA, 63 nt, Human
ucuuuaaggaaguucaaaaggauguugucuuguuaacacuggaacgaauauaaaucuucaaaa

SEQ ID NO: 6177 - RNA, 62 nt, Human
ucuuuacaacuguuuaaucaguuuuauuuuuguacaguauuagugaccuaaguuauuuugcu

SEQ ID NO: 6178 - RNA, 62 nt, Human
ucuuuacuuuuuccuuuuccuucuuaaguuaggacaguguuaaaucuuagacaaucccuuga

SEQ ID NO: 6179 - RNA, 62 nt, Human
ucuuuauaaacuaugccuuccagacaauugauaaugcugcuauaauuaguauuauguugaua

SEQ ID NO: 6180 - RNA, 62 nt, Human
ucuuucaccugucaauauuaauaagaaaauagucucaucucacuuaaaugaggcaaauguaa

SEQ ID NO: 6181 - RNA, 63 nt, Human
ucuuuccaguuccuuucaguaucaugaaaggacucacacuggagagaaacccuaugaguguaa

SEQ ID NO: 6182 - RNA, 64 nt, Human
ucuuucuacauuaacuaguaagacauaaagauuugaaacuggaacuauauuauacuuuuuaacc

SEQ ID NO: 6183 - RNA, 63 nt, Human
ucuuucuguuucugccccucuuccuucuuccuucugugacuuaacuuuguaaaggggauaugg

SEQ ID NO: 6184 - RNA, 61 nt, Human
ucuuugaacucuuaagguuuuugugagaaaaggacugugaauucaaaacaauaaggcacuu

SEQ ID NO: 6185 - RNA, 63 nt, Human
ucuuugauuaccgacuacacaauuauguaccaucacaguauuaguggaaaaguaccaugugau

SEQ ID NO: 6186 - RNA, 61 nt, Human
ucuuuggaaauaauuuuuauuaaauuucaauaaacugugaaucccaaugguauuuuacuuu

SEQ ID NO: 6187 - RNA, 62 nt, Human
ucuuuuaaaaucauguaucuugauuguugauuuaaugaaggauuuccuuuuaaugcugcuuu

SEQ ID NO: 6188 - RNA, 62 nt, Human
ucuuuucuuggugaaagcugagcacuucauaggcuguuuacagguccuucuccacaggaaaa

SEQ ID NO: 6189 - RNA, 64 nt, Human
ucuuuugcagcuuugcagauacccagacugagcuggaacuggaauuugucuuccuauugacucu

SEQ ID NO: 6190 - RNA, 62 nt, Human
ucuuuugccgugguucugagcauucaccucaccauguuuacaaagaacuguuuuguauauag

SEQ ID NO: 6191 - RNA, 61 nt, Human
ucuuuugugcuuucaguuuguauaaaaaagcuuugagauuaaaggaaaaaaaaaauuuuua

SEQ ID NO: 6192 - RNA, 64 nt, Human
ucuuuuuuaaaguuuuuuuuuaaaauauugauuugaaugcaguaggcuuuuuuguauaaaauua

SEQ ID NO: 6193 - RNA, 62 nt, Human
ucuuuuuuaacuguuaaaccaaaggaaagcacaaaugaaggaaauccuguguaaagcauuga

SEQ ID NO: 6194 - RNA, 64 nt, Human
ugaaaaaauuggauaaaguauaggaggguuacuuggggccaguaaaucaguagacugaacauuc

SEQ ID NO: 6195 - RNA, 64 nt, Human
ugaaaaauagggugacaugucagucaaauucugaucaacuggaacuugaguuuccaguuaaauu

SEQ ID NO: 6196 - RNA, 63 nt, Human
ugaaaacagaugaccauaauuuuuuuuaaagaagagugacuuauuuugucuuauucuuaagga

SEQ ID NO: 6197 - RNA, 62 nt, Human
ugaaaacauuuguuauuggcuauuucagguguuuugcugcuagaaauuauuaaaguuacaca

SEQ ID NO: 6198 - RNA, 62 nt, Human
ugaaaaccaauguguuauugaaacaaaucaauggcaguguuaauccauaagaguucugauuu

SEQ ID NO: 6199 - RNA, 63 nt, Human
ugaaaacuccagccuuauuaaacacuugagaguucacacuggagaaaggccauaugaaugcau

SEQ ID NO: 6200 - RNA, 62 nt, Human
ugaaaaguaauauuuuuuauauuuuaacauuggacaguguuagccaguuguaaugauguauc

SEQ ID NO: 6201 - RNA, 64 nt, Human
ugaaaaguuacaguagucagcucugauaaaaaaaugaugcaguagggugaggguaggaaaaagc

SEQ ID NO: 6202 - RNA, 62 nt, Human
ugaaaauauuuguguuuguuuugucugacuaacuugcugcuaaaugcuaucuuuaggugugu

SEQ ID NO: 6203 - RNA, 62 nt, Human
ugaaaauggaguucuggguuggaggcuuauuccauguuuacacaauuaaaauugcaguguuc

SEQ ID NO: 6204 - RNA, 62 nt, Human
ugaaaauuugaaaaacaugauuuuuuuaaguuucucaucucaccagucuugguguuuauauu

SEQ ID NO: 6205 - RNA, 63 nt, Human
ugaaacauuucaacaucacaucacucaccauuuuaacacuggaagccacuugaacguguccuu

SEQ ID NO: 6206 - RNA, 64 nt, Human
ugaaacccccaaaacuugaaauugugaacauuugacaugcaguaaaggccaccucaucacccag

SEQ ID NO: 6207 - RNA, 62 nt, Human
ugaaacugcauaguaaugagacugugcacacugauguuuacaagauugaaagagucuuucuc

SEQ ID NO: 6208 - RNA, 62 nt, Human
ugaaagacuugguugcccacugccuaacuguguacaguguuaccagugucccauuauggaua

SEQ ID NO: 6209 - RNA, 64 nt, Human
ugaaagcaaagccuggguggguacuggcagugcaaaggccaguaggccaccaucccuggcccca

SEQ ID NO: 6210 - RNA, 63 nt, Human
ugaaagcacuuuagggauuguagauggcuaacaagcaguauuaaaauuucaggagccaaguca

SEQ ID NO: 6211 - RNA, 64 nt, Human
ugaaaguauugcaguauugaugccauuguagaauagaacuggaauuccauucuuuuugcaauuu

SEQ ID NO: 6212 - RNA, 61 nt, Human
ugaaaguucugucccugcucugcugcuuucgccccugcugacccucgucagggucaccccc

SEQ ID NO: 6213 - RNA, 62 nt, Human
ugaaauaauuguacauaauuuauuuuaguacugacaguguuacagauucuaauuuaugguaa

SEQ ID NO: 6214 - RNA, 62 nt, Human
ugaaauacagguuuauuguauagauacauuauuuaugaaggauaaagaucuauacaugaaca

SEQ ID NO: 6215 - RNA, 62 nt, Human
ugaaauagguuaaaucuuauauaaauauuacuuugugcaauauuguuguguaguuaaaugca

SEQ ID NO: 6216 - RNA, 62 nt, Human
ugaaauauuuauuaagggaaaacuaaguuacugaaugaaggaaccucuuucuuacaaaacaa

SEQ ID NO: 6217 - RNA, 61 nt, Human
ugaaauuaauuuuaaaacauauuaaacagaaaaccugcugacaugccugugaaacugauac

SEQ ID NO: 6218 - RNA, 62 nt, Human
ugaaauuccagcugguuucucuagcaccuaguguuguuuacaagaaggccacggugcucuua

SEQ ID NO: 6219 - RNA, 62 nt, Human
ugaaauuguaucucagucuaaggucucaugcuguugcugcuacugucuuacuauuauagcaa

SEQ ID NO: 6220 - RNA, 63 nt, Human
ugaacaaacacaaggaccugaagacacacggguucacacuggaguccugccguagcaugauug

SEQ ID NO: 6221 - RNA, 63 nt, Human
ugaacaccuaggaaugcacacaccgugcuucucagacacuggagacgcaaaggcaggaggaug

SEQ ID NO: 6222 - RNA, 61 nt, Human
ugaacacguggguauuuaauaagaaacaugaugugagauuacuuugucccgcuuauucucc

SEQ ID NO: 6223 - RNA, 62 nt, Human
ugaacauguccacccgacagcuccugaguuuauaucaucucaacccucacaacccacagagg

SEQ ID NO: 6224 - RNA, 62 nt, Human
ugaaccauuugguaccugguguuaacuggaguccuguuuacaagguggagucggggcuugcu

SEQ ID NO: 6225 - RNA, 62 nt, Human
ugaacucauauuccuuucuaauauagcacagcugucaucucauuuuggacacugaggccuuu

SEQ ID NO: 6226 - RNA, 63 nt, Human
ugaagaaggaagaaaugagagucuagacucaagggacacuggauggcaagaaugcugcugaug

SEQ ID NO: 6227 - RNA, 61 nt, Human
ugaagacacaaaaguuaauuggaagaaauaaaaacugugaacgaagacccagcaugacaua

SEQ ID NO: 6228 - RNA, 62 nt, Human
ugaagagcuuuugcucuugcauuagauuugaagauguuuacauuguuguuauuguuauguau

SEQ ID NO: 6229 - RNA, 63 nt, Human
ugaagauaguaggaaauggaguacagaaaggcauacaguauuauguuacaguggagugcuuuc

SEQ ID NO: 6230 - RNA, 62 nt, Human
ugaagaugcuguacccacuugaacaguccucagguguuuacauaaauacuauguuuuacagu

SEQ ID NO: 6231 - RNA, 62 nt, Human
ugaagauuagaugaaauuggaaauaaaccaacauuguuuacauuccaggagacuuguagcuc

SEQ ID NO: 6232 - RNA, 62 nt, Human
ugaaggaaaaggggacaggaacaaaggaccaaaaauaagcuacauguuuuauuucuucaucg

SEQ ID NO: 6233 - RNA, 62 nt, Human
ugaaguaauugugaccacaaaacaucuuuuuuacaugaaggagcuguguaucauuugaaauu

SEQ ID NO: 6234 - RNA, 61 nt, Human
ugaagucaggaguucgagaccauccuggcuaacacugugaaaccccgucucuacuaaaaau

SEQ ID NO: 6235 - RNA, 64 nt, Human
ugaagucauauuauauaauaugauaaaaauauucucaugcaguauuuuaaauaauuucaaauuc

SEQ ID NO: 6236 - RNA, 61 nt, Human
ugaaguuuuggagauauguuucucucugaaauuacugugaauauuuaacaaacacuuacuu

SEQ ID NO: 6237 - RNA, 62 nt, Human
ugaaguuuuuuuguuuuuuuuguuuuccuuuuuggugcaauaaaguuuguuuuggcagcccu

SEQ ID NO: 6238 - RNA, 63 nt, Human
ugaauaaauaagucacagagaauguaaauuuuguacaguauuagaauguguaaaugaagcuug

SEQ ID NO: 6239 - RNA, 63 nt, Human
ugaauaaguagaccccaagcauccuuuucuaaaaagugacuuaaaauaagccaacagacucuc

SEQ ID NO: 6240 - RNA, 64 nt, Human
ugaauagaagcagaaaaacauuuagggauaacaucaggccaguagaauuaagccucuccaccug

SEQ ID NO: 6241 - RNA, 64 nt, Human
ugaaucacaauguaaauauuacacaucaagcgaugaaacuggaaaacuacaagccacgaaugaa

SEQ ID NO: 6242 - RNA, 62 nt, Human
ugaaucauggagaaaucucauaauauuacacuugaugaaggaauaugguaagaggagccaua

SEQ ID NO: 6243 - RNA, 61 nt, Human
ugaaucggaacgauagucucaugcagaaaauagugagauuaagaucauccuuauuguuucu

SEQ ID NO: 6244 - RNA, 61 nt, Human
ugaaugccaacagacaggccacucuuuggucagccugcugacaaauuuaagugcugguacc

SEQ ID NO: 6245 - RNA, 63 nt, Human
ugaauguuagucaucguuauuauauucaucaucaucaguauuauuauuuguagaaaggcuuuu

SEQ ID NO: 6246 - RNA, 61 nt, Human
ugaauguugugauguauucuagcuaauguaauaacugugaaguuuacauuguaaauaguau

SEQ ID NO: 6247 - RNA, 61 nt, Human
ugaauguuuauaccuuuuguuuuccuugccgcgacugugaagauaaaguucaaaaguauuu

SEQ ID NO: 6248 - RNA, 64 nt, Human
ugaauucugugaauggaaacguggcucauuugcaucaugcaguaagugggagugugguagcaca

SEQ ID NO: 6249 - RNA, 62 nt, Human
ugaauucuuuuuuauccuaauggcagauccaauuucaucucauucauuuuuuuaaccauaac

SEQ ID NO: 6250 - RNA, 62 nt, Human
ugaauugcacugaacagaauuaagaaauacucaugugcaauaggugagagaauguauuuuca

SEQ ID NO: 6251 - RNA, 63 nt, Human
ugacaaacaaacaacaucaaggcaaauccaauaaucaguauuaccauggcaaaaagaggaaac

SEQ ID NO: 6252 - RNA, 62 nt, Human
ugacaaagaguaaguaagcaguauucuugggagucaguguuauguguuucagcagaguauua

SEQ ID NO: 6253 - RNA, 59 nt, Human
ugacaagaaaugcaguuaaaaaaccaaauuucaguauuauuggugccaacaugucuauc

SEQ ID NO: 6254 - RNA, 62 nt, Human
ugacaaucuacugugccacugugcuacuaacucuuguuuacaaaauuugauucuaaguugaa

SEQ ID NO: 6255 - RNA, 62 nt, Human
ugacacauugcuugaccugauuuaugcagaauuaauaagcuauuuggauaguguagcuuuaa

SEQ ID NO: 6256 - RNA, 63 nt, Human
ugacacucaaaauccuucagaucuggaaaccggcucaguauuaacccuaccuuugguuguccu

SEQ ID NO: 6257 - RNA, 63 nt, Human
ugacacugacagauguguuugcaaggauacggcuucaguauuacuaauuuccauguguaucug

SEQ ID NO: 6258 - RNA, 61 nt, Human
ugacagaaguccauucccaauugacuaaguaagugagauuaucucagauaaucugggucag

SEQ ID NO: 6259 - RNA, 62 nt, Human
ugacaggccaaaggccaguggaagaaacacccuuucaucucagaguccacuguggcacuggc

SEQ ID NO: 6260 - RNA, 62 nt, Human
ugacaucucuuguacacugaacucacagaacauuuguuuacaauucugugugacugucugcu

SEQ ID NO: 6261 - RNA, 61 nt, Human
ugacaugaagaguuuaguuuuuuuacuuuauaaacugugaauaugaguaugccagcugcau

SEQ ID NO: 6262 - RNA, 62 nt, Human
ugacauggauaagugagauggugucuaacgagcagugcaauauuaggcggugcaauagaggc

SEQ ID NO: 6263 - RNA, 62 nt, Human
ugacauugauuuuuuuuuuuucguuuucuuucuugugcaauaccuacaauggugcuguguuu

SEQ ID NO: 6264 - RNA, 64 nt, Human
ugacauuucucuguuacucuagaggguuucucagauggccaguaggcuccucccugcuuagggu

SEQ ID NO: 6265 - RNA, 64 nt, Human
ugacauuuuuaauacaauuucugcuauaauuuuuguaugcaguaggcguuacuaauaaacauuu

SEQ ID NO: 6266 - RNA, 62 nt, Human
ugacauuuuugauaaauuauguuuguacuaguugaugaaggaguuuuuuuuaaccuguuuau

SEQ ID NO: 6267 - RNA, 61 nt, Human
ugaccaaauaugcagccuauaacaccuuucaccacugugaacagugccgccaguacaugga

SEQ ID NO: 6268 - RNA, 64 nt, Human
ugaccagaucagcugcugaagcccugucccuggauaaugcaguauuucaagacugccuuuaugc

SEQ ID NO: 6269 - RNA, 62 nt, Human
ugaccccuggggaaugccccauggcccagaaugaugcugcuaguuuucuacugagugaagcc

SEQ ID NO: 6270 - RNA, 63 nt, Human
ugacccuacaacugcccugggacauuucacuguaccaguauuaacugcaaacagcaauaauug

SEQ ID NO: 6271 - RNA, 61 nt, Human
ugacccuugcccuuuuccacccuucgccaguccacugugaaaagcuggguugauugugcgg

SEQ ID NO: 6272 - RNA, 62 nt, Human
ugaccuccuuauguauucucaauuaccuguauuugugcaauaaauuggaauaauguaacuug

SEQ ID NO: 6273 - RNA, 61 nt, Human
ugaccuggauuugacaccugaauauuuguucccccugcugaaaauaccuccugauugcacu

SEQ ID NO: 6274 - RNA, 64 nt, Human
ugaccuucuacugauuagauuuucaguuuucuuucaaacuggaaaugccuccauaaauaugauc

SEQ ID NO: 6275 - RNA, 61 nt, Human
ugacguggauguggcugcccaggaaaagacuuaacugugaaaaaguacugagaacccaccu

SEQ ID NO: 6276 - RNA, 62 nt, Human
ugacucagcacuuuguucacuggcucagcaguuauguuuacacaucauuuuuauguuccugc

SEQ ID NO: 6277 - RNA, 62 nt, Human
ugacuccccauacauguugcagcuuugaaaacauucaucucagaguuagguauaaagacaua

SEQ ID NO: 6278 - RNA, 64 nt, Human
ugacucuauuaccuguuuugccuuauacauuuuagaaacuggaaauuuuuuaaagaaaaugcuu

SEQ ID NO: 6279 - RNA, 64 nt, Human
ugacucucucaugacugcacaccccauucaggcagaggccaguacagaggaggagccauugugg

SEQ ID NO: 6280 - RNA, 62 nt, Human
ugacugacuccugaauuggaagaggaagaacuucuguuuacagaaaacuguauuguuauaua

SEQ ID NO: 6281 - RNA, 62 nt, Human
ugacuggaaacaaggaaggacauuuccgugagagucaucucaaacacugcuuaaggaaaaga

SEQ ID NO: 6282 - RNA, 62 nt, Human
ugacuuaggaggacagucuugcuaccccaagucacuaccucacucaccucugagggauuuuc

SEQ ID NO: 6283 - RNA, 64 nt, Human
ugagaacuuaaaaagugaacauugaaacaucgacguaacuggaaauuaggugggauauuugaua

SEQ ID NO: 6284 - RNA, 61 nt, Human
ugagaagaagccccacugcccucgcuccuaggcccugcugagcugcagcaccugcucuagg

SEQ ID NO: 6285 - RNA, 62 nt, Human
ugagaagauucgcccuguaccccaaaccccuuuccaguauuacccuuaaugcuugagaaccu

SEQ ID NO: 6286 - RNA, 62 nt, Human
ugagaauuuuuuaacauaugcaagucagccaaacauaagcuaccaaaauaaagagcaaugug

SEQ ID NO: 6287 - RNA, 61 nt, Human
ugagacccugucucaccaaagaaaaaaaaaaggugagauuaaucuucacuauauauuuuaa

SEQ ID NO: 6288 - RNA, 62 nt, Human
ugagacucugucucaaaaaaaaaaaaaaaaguaccuaccucagguagggacugaauaaacac

SEQ ID NO: 6289 - RNA, 62 nt, Human
ugagacugacagcuuugcagguagcaguagugugugcugcuauuguggaauauacgugugua

SEQ ID NO: 6290 - RNA, 62 nt, Human
ugagagccucuccuucaccuuuugagcaacugagucaucucaaguccugagcucugcucugc

SEQ ID NO: 6291 - RNA, 62 nt, Human
ugagaggacaagaagacacaguuuuagaaucuacugcugcuaaagcacauuaaaaacaaauc

SEQ ID NO: 6292 - RNA, 63 nt, Human
ugagaggagaaggagggagggaaaaggggucaggcacacuggacaggguucucuaagcaguga

SEQ ID NO: 6293 - RNA, 62 nt, Human
ugagaguuuagucugccauuaaaaaaacucauucucaucucaugcauuauuaugcuugcuac

SEQ ID NO: 6294 - RNA, 62 nt, Human
ugagauguuucagugaaccaaaguucugauaccuuguuuacauguuuguuuuuauggcauuu

SEQ ID NO: 6295 - RNA, 61 nt, Human
ugagcagguuuacaauuuagcuuacauuuuucgacugugaacgugaauaggcugcuuuuug

SEQ ID NO: 6296 - RNA, 62 nt, Human
ugagcauguacugagccuuguaauucuaaaugaauguuuacacucuuuguaagaguggaacc

SEQ ID NO: 6297 - RNA, 62 nt, Human
ugagccacuagaccaagcuuuaccugaagcagagcuaccucagaacuuuucagcuaugugag

SEQ ID NO: 6298 - RNA, 63 nt, Human
ugagccagaaaccagggcuucccuacccccagcugacacuggaccccaacauguaugcucagu

SEQ ID NO: 6299 - RNA, 63 nt, Human
ugagcugagaguuuacaggcacugcagaagcuguucaguauuauauguguauaugcuauuuuu

SEQ ID NO: 6300 - RNA, 63 nt, Human
ugagcuggguaggcucuaaacuucacaauaacccugugacuuaacuacuuuaucuccauuuug

SEQ ID NO: 6301 - RNA, 62 nt, Human
ugagcuuugguuuuuagaaauaaagugcaugaauugcugcuaugcuguauccuaguauccca

SEQ ID NO: 6302 - RNA, 64 nt, Human
ugaggaaaggagggaaaguuccagcaguuucaugagaugcaguauugaguguucuaguuccugg

SEQ ID NO: 6303 - RNA, 62 nt, Human
ugaggauuuuuguagagacugaagcaguuguuucuguuuacauguuguuuauugaggaggug

SEQ ID NO: 6304 - RNA, 61 nt, Human
ugaggcuccacucauugucuugugacuuccaucccugcugaauggggcugcaaggccaagg

SEQ ID NO: 6305 - RNA, 61 nt, Human
ugaggcugggacugcgagugcugacgccaccuuccugcugaggugggacugggcccuggac

SEQ ID NO: 6306 - RNA, 63 nt, Human
ugaggcuuagaauuucaaccacgugucaggucagacaguauuauaaacuguacuuugcugucu

SEQ ID NO: 6307 - RNA, 61 nt, Human
ugagggauccugcccugaaucuccauagucuccacugugaacugaggaggggaggggugug

SEQ ID NO: 6308 - RNA, 62 nt, Human
ugaggguguugagggugucacgagcccauucucauguuuacagggguugugggggcagaggg

SEQ ID NO: 6309 - RNA, 62 nt, Human
ugagguaacuaguucaguuuguugggauggaagcaugaaggaaagggcuagagaaguaugaa

SEQ ID NO: 6310 - RNA, 64 nt, Human
ugaggucucauacaaggauauuuggagugaaaugcuggccaguacuuguucucccuugccccaa

SEQ ID NO: 6311 - RNA, 62 nt, Human
ugagguucuuuucuacaugaugaccuucagcuccugcugcuagucuccaauugccaagggaa

SEQ ID NO: 6312 - RNA, 61 nt, Human
ugaguaacccagccugccguuuguaugugagagccugcugagaugaagaaaucacuucaug

SEQ ID NO: 6313 - RNA, 63 nt, Human
ugaguaacuuguagccaagacagcagcugcuaugcacacuggaguccaccauaccaaagcacg

SEQ ID NO: 6314 - RNA, 62 nt, Human
ugaguaaugugaucgcuugguuauccagaaguauuguuuacauuaaacucccuuucauguua

SEQ ID NO: 6315 - RNA, 62 nt, Human
ugaguacaagcacagaaacaucuuuacgguggcaucaucucauuuuuuaggaagacaugaua

SEQ ID NO: 6316 - RNA, 61 nt, Human
ugaguaccgggcuacuucuuaaaugccgucacuccugcugagauaaaugcgucuuuaaaaa

SEQ ID NO: 6317 - RNA, 62 nt, Human
ugaguagagaaagagauaaaaauaaaaguaucucaugaaggaaagagauuuugccucucuuu

SEQ ID NO: 6318 - RNA, 63 nt, Human
ugaguauuuucaagaaaagaauaaaaacauuaaugcaguauuagguuaacuggauaucaacua

SEQ ID NO: 6319 - RNA, 64 nt, Human
ugagugaguuccccucuacuuuuagccuuccacccaaacuggaagccucuaggugcuaucaauu

SEQ ID NO: 6320 - RNA, 61 nt, Human
ugaguggcucugccaauccauaccacccuugguacugugaaaaggcuucuuggcagccagg

SEQ ID NO: 6321 - RNA, 62 nt, Human
ugaguguagaauuuuaaauggcaggauuuuacaguguuuacaugcaagugcauuuuauaagu

SEQ ID NO: 6322 - RNA, 62 nt, Human
ugaguguguguguacgcacacacacuggggauagauaagcuaccugguaaaggguuugaaca

SEQ ID NO: 6323 - RNA, 63 nt, Human
ugaguuaccucaguuucccaacaauggaccuuggcacacuggaguaacaauacauaacagagu

SEQ ID NO: 6324 - RNA, 62 nt, Human
ugaguuacguuuauugccccaucccuucacugaauguuuacauuaacaaacaccagagagca

SEQ ID NO: 6325 - RNA, 62 nt, Human
ugaguuauaucuaauuuuucacucuuauaaauagugcugcuaugaaugucuguaaaaaaaaa

SEQ ID NO: 6326 - RNA, 61 nt, Human
ugaguugacuuaacauugaguucaaguauuuguugagauuaaaguguuuauguuaagagga

SEQ ID NO: 6327 - RNA, 62 nt, Human
ugaguuggcaugcauacaagauuuacuaagugggauaagcuaauuauacuuuuuguugugga

SEQ ID NO: 6328 - RNA, 61 nt, Human
ugaguuuucacucuucuaaugcaagggucucacacugugaaccacuuaggaugugaucacu

SEQ ID NO: 6329 - RNA, 61 nt, Human
ugauaaagaacuuagucaucccuuccaccuccuacugugaagaacagacccugggucccac

SEQ ID NO: 6330 - RNA, 62 nt, Human
ugauaaauucuuucuuugagaaagacaauuuuaauguuuacaacaauaaaccauguaaauga

SEQ ID NO: 6331 - RNA, 62 nt, Human
ugauaacuucgcuacauaacaaggaaaauauaaauguuuacaaacagcuuaaagauuugcau

SEQ ID NO: 6332 - RNA, 64 nt, Human
ugauaauaauuaucuuugaaguagaacaauucuguuaacuggaaaaucacaggauauauccauc

SEQ ID NO: 6333 - RNA, 62 nt, Human
ugauagagaaaggaguucucguucuuccucauugucaucucaucacucaucaaagagagacu

SEQ ID NO: 6334 - RNA, 63 nt, Human
ugauauagagaaaucuggcuggcuacaguguagaucaguauuaggaauauuucuaaagauccu

SEQ ID NO: 6335 - RNA, 62 nt, Human
ugauaucagauaauuuagauuguggacuuaguuacaguguuaucucuuaccuuaaaaaacuc

SEQ ID NO: 6336 - RNA, 62 nt, Human
ugauauuaagaucaaagggaggaagggaagacagcaguauuaauucacccuagauuacucaa

SEQ ID NO: 6337 - RNA, 61 nt, Human
ugaucaggagaugcucuuuaagaaguucgcaccccugcugacaccagaacagcccaaauca

SEQ ID NO: 6338 - RNA, 63 nt, Human
ugauccaaauuugaacuggccaaccagucuuuaaaacacuggacuagaagagauaaugauuga

SEQ ID NO: 6339 - RNA, 62 nt, Human
ugauccugaaggguuagcagcacuuuacgcaagucaguguuaguaggguaagugggaacagu

SEQ ID NO: 6340 - RNA, 63 nt, Human
ugaucgcucaacccuuaguaaacacgagaggacacacacuggaggcaaacccuaugaauguga

SEQ ID NO: 6341 - RNA, 62 nt, Human
ugaucuuagcucacuuuccaauaacagaaggaguuguuuacagaugaauaguaucacaucau

SEQ ID NO: 6342 - RNA, 63 nt, Human
ugaucuuucaucccuaagauaguuugagagagcucacacuggauauauaaguuauuuguugca

SEQ ID NO: 6343 - RNA, 61 nt, Human
ugaugaaauaugaguccucagcuugguucccagccugcugauugacuugggcugcuggugc

SEQ ID NO: 6344 - RNA, 62 nt, Human
ugaugagggugcaugaguguauguuugcauucacaugaaggaauugcuuuucacaccagaaa

SEQ ID NO: 6345 - RNA, 62 nt, Human
ugaugaugaggauggcaugacugcagagccauccucaucucauuuuuucacgucauuuucag

SEQ ID NO: 6346 - RNA, 62 nt, Human
ugaugcagcagauccagggaauguuaccuguuucugcugcuagaagauccaggaaauuggga

SEQ ID NO: 6347 - RNA, 64 nt, Human
ugaugcagccauccuggaccuuggcuguggucugguaacuggaacccagugacguaaucaggug

SEQ ID NO: 6348 - RNA, 61 nt, Human
ugaugcauuguuuuugcaauugaccuaugacaaacugugaaccugcagauuucaccuauuu

SEQ ID NO: 6349 - RNA, 64 nt, Human
ugaugccucaggucugccuuuuuuucuggagaauaaaugcaguaauccucucccaaauaagcac

SEQ ID NO: 6350 - RNA, 62 nt, Human
ugauggcuggaucuggggcagccaccuugcuaccaugaaggaaaggccaagacaaucaucca

SEQ ID NO: 6351 - RNA, 62 nt, Human
ugauggguuuguguguauggugucaugagauccucuaccucauaacaaaaggacagugggua

SEQ ID NO: 6352 - RNA, 61 nt, Human
ugaugucugauuuugccguucauguuagagccuacugugaauaagaguuagaacauuuaua

SEQ ID NO: 6353 - RNA, 62 nt, Human
ugauguggcuuaacaaucagacuucuucuauuuuugcugcuauggugguuguauuagagaac

SEQ ID NO: 6354 - RNA, 63 nt, Human
ugauguuuguguaugugggaguacucucaucacuacaguauuacucuuacaagaguggacuca

SEQ ID NO: 6355 - RNA, 64 nt, Human
ugauuaagaagaugguuuuguuauuaaauagcauuaaacuggaauugacaagaguguugagcau

SEQ ID NO: 6356 - RNA, 62 nt, Human
ugauuagagacaucaccgcuaaaaaacuacauuuauaagcuaggauuuguuauaugcaaaua

SEQ ID NO: 6357 - RNA, 62 nt, Human
ugauuagccagaagucauguuccagcuuggacucaugaaggauuaaaaaucugcaucuucca

SEQ ID NO: 6358 - RNA, 61 nt, Human
ugauucaccauugaggaacaucaucaauugcagacugugaaguuguguauuuaaugcauua

SEQ ID NO: 6359 - RNA, 64 nt, Human
ugauucuuuguacaguuuauccugauguugcuuguaaugcaguagaggcuauuucgccuucgcu

SEQ ID NO: 6360 - RNA, 63 nt, Human
ugauugaauguagacagggauaugcguauaguuuucaguauuaguucuagauaacacuaaauu

SEQ ID NO: 6361 - RNA, 62 nt, Human
ugauugauguauuuuaucuauaguuauuuagacauguuuacaugcagcagauaauuguucau

SEQ ID NO: 6362 - RNA, 61 nt, Human
ugauugcuuaugaaaaacaaaaugauguacauuacugugaauuuuuauaccacucauuuuu

SEQ ID NO: 6363 - RNA, 62 nt, Human
ugauugggaccaggaggggucaacacuuucauaucaguguuacagugaacuaaagcuauuau

SEQ ID NO: 6364 - RNA, 61 nt, Human
ugauuuacaaaaguagcauaguagaugaugacaacugugaacucugacauaaauuuagugc

SEQ ID NO: 6365 - RNA, 64 nt, Human
ugauuuccugggugcaugcuaggaugauggggcuugaugcaguagggaagagacgauguaaaaa

SEQ ID NO: 6366 - RNA, 61 nt, Human
ugauuucugggccuguaaugucuaaaaacgcucccugcugauguuuugcaagugacugugu

SEQ ID NO: 6367 - RNA, 62 nt, Human
ugauuugauugugauuagagaaccuuggacauuuugcugcuaaagaaucuuuuuuccccucu

SEQ ID NO: 6368 - RNA, 63 nt, Human
ugauuuuuugcuuguuuguuuguuuuguacuaaaacaguauuaucuuuugaauaucguaggga

SEQ ID NO: 6369 - RNA, 62 nt, Human
ugauuuuuuuaaauuaugggaaauuaaugaaagauguuuacaugaauaauguuugcccuuac

SEQ ID NO: 6370 - RNA, 62 nt, Human
ugcaaaaucugccucccggguucaagcgauucuccuaccucagccucccgaguagcugggau

SEQ ID NO: 6371 - RNA, 62 nt, Human
ugcaaacuucaccuccugaguucaagccauucuccuaccucagccucccaaguagcugggac

SEQ ID NO: 6372 - RNA, 62 nt, Human
ugcaaacuuugccucccagguucaagugauucuccuaccucagccucccgaguagcugggau

SEQ ID NO: 6373 - RNA, 62 nt, Human
ugcaaaggccuaaacugagaauuaaucuaaaagucaguguuauuuaaacauuuucaaugugc

SEQ ID NO: 6374 - RNA, 63 nt, Human
ugcaaaguugauaacauuucaaacccugaaggacagugacuuauuauguaaguucaauuuugu

SEQ ID NO: 6375 - RNA, 62 nt, Human
ugcaaaguuuuggucagucauauacaauaaagaaucaucucaccccgaaaugcaaauugcag

SEQ ID NO: 6376 - RNA, 62 nt, Human
ugcaaccuccgcccccugggaucaagcgauucuccuaccucagccucccaaauagcugggac

SEQ ID NO: 6377 - RNA, 62 nt, Human
ugcaaccuccuccuccuggguucaagcgauucuccuaccucagccuccccaguagcugggau

SEQ ID NO: 6378 - RNA, 62 nt, Human
ugcaaccucugccucccggguucaagcgauucuccuaccucagccuccuuaguagcugggac

SEQ ID NO: 6379 - RNA, 62 nt, Human
ugcaaccucugccucccguguucaagcaauucuccuaccucagccuacuggguagcugggac

SEQ ID NO: 6380 - RNA, 62 nt, Human
ugcaaccucugccuccuggguucaaacgauucuccuaccucagccucccuaauagccagggg

SEQ ID NO: 6381 - RNA, 62 nt, Human
ugcaacuucugccuccuggguucaagcgauucuccuaccucagcuuccuaaguagcugggau

SEQ ID NO: 6382 - RNA, 62 nt, Human
ugcaacuugggccucccagguucaagugauucuccuaccucagccucccaaggagcugagau

SEQ ID NO: 6383 - RNA, 62 nt, Human
ugcaagcuccgccucccagguucaugccauucuccuaccucagccucccgaguagcugggac

SEQ ID NO: 6384 - RNA, 61 nt, Human
ugcaaguuaggccaaagcccacauucaaagaaaugagauuaacucuuaaguaauguauuaa

SEQ ID NO: 6385 - RNA, 61 nt, Human
ugcaccagcugccugggccccacccuccugacuccugcugaugguuaagggccgggagcag

SEQ ID NO: 6386 - RNA, 63 nt, Human
ugcaccuaguuuuuucccauugguuccagacaaaggugacuuauaaauauauuuaguguuuug

SEQ ID NO: 6387 - RNA, 64 nt, Human
ugcacguuuacauguuuugagcuaugcuucaaacacaacuggaaagccaucaaucuucaaaggc

SEQ ID NO: 6388 - RNA, 61 nt, Human
ugcacucaguuuacucucucccucuacuaauuuccugcugaaaauaacacaacaaaaaugu

SEQ ID NO: 6389 - RNA, 62 nt, Human
ugcacuccagccuaggggacaagagcgcgagacuucaucucaaaaaaaaaaaaaaaaaaaaa

SEQ ID NO: 6390 - RNA, 61 nt, Human
ugcacucguguuaagucaaaggcuauaagaaacacugugaaaaguucauauucauccauug

SEQ ID NO: 6391 - RNA, 63 nt, Human
ugcacuucaaaaccacagcugcuguaaauucuuaaacacuggagagccauccuuugguuuaaa

SEQ ID NO: 6392 - RNA, 62 nt, Human
ugcacuucuguucauuuccauugcugcuuauaugcaguguuagccgaauuagauuuacaaga

SEQ ID NO: 6393 - RNA, 62 nt, Human
ugcagaaggugugcuuuugcacuugcagacugcucuaccucaguguuuccuugggagacuuu

SEQ ID NO: 6394 - RNA, 63 nt, Human
ugcagaauuaacagaccucuucuccucaugguacacaguauuacaguguugaaguaaugguga

SEQ ID NO: 6395 - RNA, 61 nt, Human
ugcagacaaagaccaggggcagcucccgagggcacugugaaggcucccaugccacacagug

SEQ ID NO: 6396 - RNA, 62 nt, Human
ugcagacagucuguuaugcacugugguuucagaugugcaauaauuuguacaaugguuuauuc

SEQ ID NO: 6397 - RNA, 62 nt, Human
ugcagaccuauuagaucugcaguuuaaguugccaugcugcuaggaaauuguccuuuuucuuu

SEQ ID NO: 6398 - RNA, 62 nt, Human
ugcagauauauauucgauaaaucaguguacuugacaguguuaucugucacuuauuuagaccg

SEQ ID NO: 6399 - RNA, 62 nt, Human
ugcagcaucauguuguaauuaauuuuuuggaaguuuccguuaaauguaauauugcuucucuu

SEQ ID NO: 6400 - RNA, 62 nt, Human
ugcagccucaacccccugagcucaggucauccugcuaccucagccucuucaguugcugagac

SEQ ID NO: 6401 - RNA, 62 nt, Human
ugcagccucaaccuccuggguucaagcaauccuccuaccucagccuccuggguagcuagcac

SEQ ID NO: 6402 - RNA, 62 nt, Human
ugcagccucaaccuucccagcucaagugauccuccuaccucagccucccaaguaguugggac

SEQ ID NO: 6403 - RNA, 62 nt, Human
ugcagccuccgccaccuggguucaagcaauucuccuaccucagcuucccgaguagcugggau

SEQ ID NO: 6404 - RNA, 62 nt, Human
ugcagccucgaacuccugggcuuaagggauccuucuaccucagccucccagguagcaggaac

SEQ ID NO: 6405 - RNA, 61 nt, Human
ugcagcuccauagaggagacggacuguagacaaugagauuaagcuucaaucacugcuccuc

SEQ ID NO: 6406 - RNA, 63 nt, Human
ugcaggaaggccugaacaugugcacccucccagggacacuggaugcgcugggagccccgggga

SEQ ID NO: 6407 - RNA, 62 nt, Human
ugcaggaaguuuaaccugcgugucaucugccuggucaucucagacccaugaaauuaggcgcc

SEQ ID NO: 6408 - RNA, 64 nt, Human
ugcaggaaucaaaaauugaagagagauauaucugaaaacuggaauaagaagcaaauaaauauca

SEQ ID NO: 6409 - RNA, 61 nt, Human
ugcagggaugcgaugcguaggugccuuucucuuccugcugaccacaagcucugugcugggg

SEQ ID NO: 6410 - RNA, 62 nt, Human
ugcaggggugcggucaugggcucaugggauucuccuaccucagccuccugaguagcugggau

SEQ ID NO: 6411 - RNA, 62 nt, Human
ugcaguaggcaagcucugcugcgaugccucugccucaucucacacugcgucaacccaaagga

SEQ ID NO: 6412 - RNA, 62 nt, Human
ugcaguccugggcuuagcuucugcccagcuuuauugcugcuauuggcaaagagcacaggacu

SEQ ID NO: 6413 - RNA, 62 nt, Human
ugcaguguuguacuagacuuuguucaggcuguucucaucucaguauugccccuuccuuucac

SEQ ID NO: 6414 - RNA, 64 nt, Human
ugcaguucaauuucuccuuggaacucuaacaggacuaacuggaaaaauacuuugaccauagcuc

SEQ ID NO: 6415 - RNA, 62 nt, Human
ugcauaaagaaugcaccacucaacuuuuuuauucauaagcuaauauuuuuuuaaaguuacau

SEQ ID NO: 6416 - RNA, 62 nt, Human
ugcauaacacugaguguuaauucuugugaaauaaauaagcuagacugccuucucuuuaauua

SEQ ID NO: 6417 - RNA, 62 nt, Human
ugcauaaccauucauuagggaguacuuuacaagcaugaaggauauuaggguaaguggcuaau

SEQ ID NO: 6418 - RNA, 61 nt, Human
ugcauagaauaaugcauucuauguagccaugucacugugaauaacgauuucuugcauauuu

SEQ ID NO: 6419 - RNA, 62 nt, Human
ugcauauauaugaaugacuaggauuaaucugguguguuuacauaggauauacauaguugaaa

SEQ ID NO: 6420 - RNA, 62 nt, Human
ugcauauguaccuguccgucaguguguggauguauguuuacaguucuacauaaaugggauca

SEQ ID NO: 6421 - RNA, 62 nt, Human
ugcaucaucuuaucauauauuccuuccuauacauuguuuacacuucaacuacggggauguuc

SEQ ID NO: 6422 - RNA, 62 nt, Human
ugcauccacgcacacauggacacagacccacacauguuuacagaacuguuguuuacuuguug

SEQ ID NO: 6423 - RNA, 62 nt, Human
ugcaugacaacucguguguaugagaaggagggauaugaaggaagauggcuugcagaguaagu

SEQ ID NO: 6424 - RNA, 62 nt, Human
ugcauguugaaguauuuggaaugaaguguucugauguuuacaacuuucaaaaaaaugauuuu

SEQ ID NO: 6425 - RNA, 64 nt, Human
ugcauucagaucugaaguagugugaguguuagaaaaaacuggaaacaucugauuucugaacuau

SEQ ID NO: 6426 - RNA, 63 nt, Human
ugcauuggggacaguuuuuauaagugggaaggacucaguauuauuauauuugagaugauaagc

SEQ ID NO: 6427 - RNA, 64 nt, Human
ugcauuucaacucaucuuuuaagugauuucagucaaaacuggaaaacaacuaagauguaguaau

SEQ ID NO: 6428 - RNA, 64 nt, Human
ugcauuugaguacagacuaauuuuuaaaauaugcuaaacuggaagauuaaacagaugugggcca

SEQ ID NO: 6429 - RNA, 62 nt, Human
ugcauuugcuuggcuccuaguaacaauucuuuuacaguauuagcacucucuuuacuaaggaa

SEQ ID NO: 6430 - RNA, 62 nt, Human
ugccaacauuagcguuggucuucucuugucaggaaugaaggaugcuugcacacaugcacccc

SEQ ID NO: 6431 - RNA, 62 nt, Human
ugccacccgugggaaugcugcccgcucugcagacugcugcuagagccagcaacuccacuaag

SEQ ID NO: 6432 - RNA, 61 nt, Human
ugccacucacggcucuguccacuagggcucagcccugcugagaaaggaccuccgaugcuug

SEQ ID NO: 6433 - RNA, 62 nt, Human
ugccacuucccagguaagcaggaggaggugccaacaguguuaggccuggcacagugucuggg

SEQ ID NO: 6434 - RNA, 64 nt, Human
ugccagaagcgaugggguaccguguaggggagccaaggccaguaguuuggggguaggagucccc

SEQ ID NO: 6435 - RNA, 61 nt, Human
ugccagcuacacuaaaagaaaauggccuucuugacugugaagagcugccugcagagagcug

SEQ ID NO: 6436 - RNA, 62 nt, Human
ugccauauuaaccccuuuguguauaaugaccaggcaguguuaaacugaguuuuuaauuugac

SEQ ID NO: 6437 - RNA, 61 nt, Human
ugccaucgcccgcugccaaucuaagccagucucacugugaaccacacgaaaccucaacugg

SEQ ID NO: 6438 - RNA, 62 nt, Human
ugccaucuuuguaguuucacaaauuuuguguaaucuaccucaaaugaauaauccaaguauug

SEQ ID NO: 6439 - RNA, 62 nt, Human
ugccauucugagccuugaagggcaaggagggaaacaguguuaccagagcccaguaagaacug

SEQ ID NO: 6440 - RNA, 62 nt, Human
ugcccaacuuucagaagaggaaaaucacacauuauguuuacauaaguagcaaaaauauauuu

SEQ ID NO: 6441 - RNA, 64 nt, Human
ugcccacaaaucccauuccaguguuacuuucugugaaugcaguaccauauucucauuuucaaug

SEQ ID NO: 6442 - RNA, 62 nt, Human
ugcccacagacaugagacaccacggguccuucaacuaccucaaguucuucaagcacauccgc

SEQ ID NO: 6443 - RNA, 62 nt, Human
ugcccacauaccuuauagcacaggcccagguggaucaucucaugcuaacaccccacaugugc

SEQ ID NO: 6444 - RNA, 62 nt, Human
ugcccagauccccggcacacacucccccaccugcuguuuacaugacccagggggugcacacu

SEQ ID NO: 6445 - RNA, 62 nt, Human
ugcccaucauugaguaaaugaacccuaaaaaugaauaagcuaaugaacuaguucauggaauu

SEQ ID NO: 6446 - RNA, 64 nt, Human
ugccccauagcuaccauucaaaagggaaaauaaccaaacuggaaaaccuucuucuauuucucua

SEQ ID NO: 6447 - RNA, 62 nt, Human
ugcccccuggcuuuauuacucccaauugaauuaucuaccucauuuuguuaauuuaauuuauc

SEQ ID NO: 6448 - RNA, 62 nt, Human
ugcccccuuccccagaacaaaacauguugaucaugugcaauauuucuuacugugccgagaag

SEQ ID NO: 6449 - RNA, 62 nt, Human
ugcccgccccuugccucgauauugccaguuucuugugcaauaaacaaucagcagcugucgag

SEQ ID NO: 6450 - RNA, 63 nt, Human
ugcccuccuggccugcaccuggaauggcagccagaacacuggagggggacccacacccucucu

SEQ ID NO: 6451 - RNA, 63 nt, Human
ugcccuggauggcccuagggcagugggcccaugagcaguauuagucuaaaggggucggaacug

SEQ ID NO: 6452 - RNA, 61 nt, Human
ugcccuggcacacacaggcacccauucccucccccugcugacauguguaugcguaugcaua

SEQ ID NO: 6453 - RNA, 63 nt, Human
ugcccuggcagugcagccaaucagaaauggcucuugugacuuaacugggcuuggauaucccug

SEQ ID NO: 6454 - RNA, 62 nt, Human
ugcccuuccccucccucgggaagccaccuaagaauguuuacaugccaaacagaauguaacac

SEQ ID NO: 6455 - RNA, 61 nt, Human
ugcccuugugugaccccaggacucaagucucagacugugaacagauguggccaugcccaga

SEQ ID NO: 6456 - RNA, 62 nt, Human
ugccgcugagaaggguugauccugcaucuggguuuguuuacagcaauuccuggacucggggg

SEQ ID NO: 6457 - RNA, 63 nt, Human
ugccgggacagcaggcaguggccaccugguacaccacacuggagccggaaggcaaggacgggg

SEQ ID NO: 6458 - RNA, 61 nt, Human
ugccgucauuuucaguuagaugauuuugcacuuugagauuaaaaugccaugucuauuugau

SEQ ID NO: 6459 - RNA, 62 nt, Human
ugccuauuugccagcauuuuuugaaguaauacacugcugcuaccuggaagaugucuaacuuc

SEQ ID NO: 6460 - RNA, 62 nt, Human
ugccucaguucucgacucuaaaggacauacugaccuaccucacagggguguugugaggauua

SEQ ID NO: 6461 - RNA, 62 nt, Human
ugccucaucccaccccaaugcuuccuuucugccaucaucucagagcaugaucacauugcaga

SEQ ID NO: 6462 - RNA, 61 nt, Human
ugccucauggugggcccuggacaggugugugguccugcugagcuguccacgugucggaaga

SEQ ID NO: 6463 - RNA, 61 nt, Human
ugccuccuaguucacuuugugucaagagcuaaaacugugaaccuaacuuucucuuauuggu

SEQ ID NO: 6464 - RNA, 61 nt, Human
ugccuccuuccuccugguguugccacuucugggugagauuaaggugcagggccugggggca

SEQ ID NO: 6465 - RNA, 61 nt, Human
ugccucucuucugcaaagcguaucaucucauugacugugaaucuguauauuauucugaugg

SEQ ID NO: 6466 - RNA, 62 nt, Human
ugccucugacaaucagaucgcucuggcggccucaucaucucaggaugagcucuuuguggcca

SEQ ID NO: 6467 - RNA, 61 nt, Human
ugccugcacgcccuguucccuccaccuagacugccugcugagggggcagugccaggagguu

SEQ ID NO: 6468 - RNA, 61 nt, Human
ugccugccuguggggccaagcccuggggcugccacugugaauaugccaaggacugaucggg

SEQ ID NO: 6469 - RNA, 64 nt, Human
ugccuggcccauuuaguuucauccuuuaguuacccaggccaguagcuuuggguuaucccuuccu

SEQ ID NO: 6470 - RNA, 62 nt, Human
ugccuggcuaauuuuuaguagagacgggguuucgcaguguuagccaggaaggucucaaucuc

SEQ ID NO: 6471 - RNA, 61 nt, Human
ugccugggcuucuuuggcgagaugauugcuuugccugcugagguuaguuuugggaagcgcu

SEQ ID NO: 6472 - RNA, 61 nt, Human
ugccuggggccucgcagcggggccagggcuccgccugcugaucggggguugugagcagcgc

SEQ ID NO: 6473 - RNA, 62 nt, Human
ugccuuauaugcugugccacucacaccgaggccaucaucucaacauuagaguugugcuagau

SEQ ID NO: 6474 - RNA, 64 nt, Human
ugccuugaaauuaaacuaugaaauuaaaggcagaaaaacuggaaaaccuacugcagguccagag

SEQ ID NO: 6475 - RNA, 62 nt, Human
ugccuuggccucccgaagugcugggauugcaggcauaagcuaccaugcugggccugaacaua

SEQ ID NO: 6476 - RNA, 64 nt, Human
ugccuuuuccaaaaugucauguaguugguuggaguuaugcaguauguagacuuuuuagacuggc

SEQ ID NO: 6477 - RNA, 62 nt, Human
ugcgaacagguaccuaucuguuucuaaauaaaacuguuuacauuccuacggaggaacccuca

SEQ ID NO: 6478 - RNA, 63 nt, Human
ugcgacucacuguagugcuggggaucccccuuguaacacuggaacugaaagacagugaugaaa

SEQ ID NO: 6479 - RNA, 62 nt, Human
ugcgauucuucuguuguaaaaaaauauauguacuauaagcuacauaaaauauuuucuauuuu

SEQ ID NO: 6480 - RNA, 62 nt, Human
ugcgcccgcggguccuccccaccugcugcuccccgugcaauaccugcugggccuccugcccg

SEQ ID NO: 6481 - RNA, 61 nt, Human
ugcggagguuagauuuacuggaaauguauucauacugugaauugugcucugaugguuaaaa

SEQ ID NO: 6482 - RNA, 61 nt, Human
ugcggccugggccccccugcccacggccagcuuccugcugaugaacaugcuguuuguauug

SEQ ID NO: 6483 - RNA, 64 nt, Human
ugcgggaagcugaccuuuaacugagggcugaucuuuaacuggaaggcugcuuucuccuuucacc

SEQ ID NO: 6484 - RNA, 61 nt, Human
uugaagggggaccuucuucuaaucuccucccugccugcugagagaguguacagaagcagcc

SEQ ID NO: 6485 - RNA, 62 nt, Human
uugaauaccuugauguuuugcauuacuucauuuauguuuacaucauguuuagaaauguuuuc

SEQ ID NO: 6486 - RNA, 62 nt, Human
uugaauucuuuuccguauguggggaugguugcuacuaccucaccgccaaguccucccccagc

SEQ ID NO: 6487 - RNA, 63 nt, Human
uugaauuuguaucuuguaugccuauguaauucaaagugacuuaguccauugaauuguguucau

SEQ ID NO: 6488 - RNA, 62 nt, Human
uugacaaagcagaguaaaaauaugcuguuuacauuguuuacuuacaaguaaggagccugaaa

SEQ ID NO: 6489 - RNA, 62 nt, Human
uugacaauaaaauggcuuuuaauuauuuguuauuuguuuacacccuauuccucaguuauuau

SEQ ID NO: 6490 - RNA, 61 nt, Human
uugacagcuuuuuuuaaauuauuucacugaagcugagauuauuagugauacaaaguuaaaa

SEQ ID NO: 6491 - RNA, 62 nt, Human
uugacaguaccuagcuguaauguuucacagagugugcugcuauuuuauaaacauuuuuauaa

SEQ ID NO: 6492 - RNA, 61 nt, Human
uugacaucggccagucugaauuucaagaaauuaccugcugaagacaagagggaucucuucu

SEQ ID NO: 6493 - RNA, 64 nt, Human
uugaccaaggcuaugcaggauugcacuagcuccauaaugcaguaauauugauaacugaagauac

SEQ ID NO: 6494 - RNA, 64 nt, Human
uugaccuaaugauuuaugcaaucucuguaauuucuuaugcaguaaaauuacuacacaaacuagc

SEQ ID NO: 6495 - RNA, 62 nt, Human
uugacuagccaucucaagcaaguuuaaucaaugaucaucucacgcugaucauuggauccuac

SEQ ID NO: 6496 - RNA, 62 nt, Human
uugacuuagcacugagagcuauuuaauaacuuuguuccguuaauuaguacuaauuaagugga

SEQ ID NO: 6497 - RNA, 62 nt, Human
uugacuugaaaaauuauauuucauauugcaaagauguuuacaaguauuuuaauuuaaguuca

SEQ ID NO: 6498 - RNA, 63 nt, Human
uugagaagauucgcccuguaccccaaaccccuuuccaguauuacccuuaaugcuugagaaccu

SEQ ID NO: 6499 - RNA, 63 nt, Human
uugagaauaacuaauguggauugaaauguagagauacacuggagugcuuuauuuagcaauauu

SEQ ID NO: 6500 - RNA, 62 nt, Human
uugagacuuuuuaaucgguucuucaaauauuucauguuuacauuaaaaauuuccagagaagc

SEQ ID NO: 6501 - RNA, 62 nt, Human
uugagagcugguguugucugaaguuuucguaucacaguguuaaccuguacucucuccugcaa

SEQ ID NO: 6502 - RNA, 64 nt, Human
uugaggcagggcaacauuaagcaacuuacauaacucaugcaguaauuucugcaguugggagaug

SEQ ID NO: 6503 - RNA, 62 nt, Human
uugaggcuucuccuucacuggagugcaccugccucuaccucauggguauaaaguaggagaac

SEQ ID NO: 6504 - RNA, 61 nt, Human
uugaggguauggagagaugguauacagcagguaacugugaauugcagaauaaauugaaaga

SEQ ID NO: 6505 - RNA, 62 nt, Human
uugagggucauuuuccuuucuguauuaauuauaccaguguuaagugacauagauaagaacuu

SEQ ID NO: 6506 - RNA, 63 nt, Human
uugaguaagugaaauuuugcuguauucauguuuuugugacuuauaaaauaggaugauaaggag

SEQ ID NO: 6507 - RNA, 62 nt, Human
uugaguauuuacuaacacguuuuucaaaagaugucaguguuauaccuaaagcuaaaaaaaag

SEQ ID NO: 6508 - RNA, 62 nt, Human
uugauaaaguauuuaauucuuuuaaaaauuauauucaucucagcuuucuuagagaauucccu

SEQ ID NO: 6509 - RNA, 61 nt, Human
uugauaaugcauauuugcaggccccacgcaaaaccugcugaaucagaagcucugagaguaa

SEQ ID NO: 6510 - RNA, 63 nt, Human
uugauccaaagcagaaucaaugucuuuuccaucucgugacuuaaaguucugugacugugaugc

SEQ ID NO: 6511 - RNA, 64 nt, Human
uugaucuuggagucucacagcagacugcaugugaacaacuggaaccgaaaacaugccucaguau

SEQ ID NO: 6512 - RNA, 62 nt, Human
uugaucuuuuucaagucuucugaaaggaaguagacaguauuacacccugaauaaauaaggug

SEQ ID NO: 6513 - RNA, 62 nt, Human
uugaugcaugugcuuuuguauggaauaaauuuuggugcaauaugaugucauucaacuuugca

SEQ ID NO: 6514 - RNA, 61 nt, Human
uugauggaggcuggcaagggaaaguuucagcucacugugaagccagacuccccaacugaaa

SEQ ID NO: 6515 - RNA, 62 nt, Human
uugaugucagguauuuacagugguuggaagauagcaguauuauuagcauaagcugcauacgu

SEQ ID NO: 6516 - RNA, 62 nt, Human
uugauucaguuuguaauaacuaguaaugagcuucuguuuacaauaaaaauucuguaaauugg

SEQ ID NO: 6517 - RNA, 62 nt, Human
uugauugauaaagggaauguugcauuugggacuaugcugcuaacgaaaugguuugaaguauu

SEQ ID NO: 6518 - RNA, 62 nt, Human
uugauugauugauugauugauacauucagcuuccugcugcuagcaaugccacgauuuagauu

SEQ ID NO: 6519 - RNA, 63 nt, Human
uugauugguuuuauuuuauguagcuugacaauucagugacuuaauaucuauuccauuuguauu

SEQ ID NO: 6520 - RNA, 62 nt, Human
uugauuuuuuuccuauaauuucauucuuguuuuuucaucucauuauccaaguucugcagacc

SEQ ID NO: 6521 - RNA, 62 nt, Human
uugcaaccuguaagaaagaauccguccgcaugacuguuuacaagcgauagaaacacguaaga

SEQ ID NO: 6522 - RNA, 61 nt, Human
uugcaaucuauuuuauauauauugacaaaagagacugugaaauacuuagccaugcagaaua

SEQ ID NO: 6523 - RNA, 62 nt, Human
uugcaauuuuuuuuuuaagcucaucagcuaucaucaguguuagcauauuuuaugugcggccc

SEQ ID NO: 6524 - RNA, 62 nt, Human
uugcacaaggagacugcccccagccuaguggcaccuaccucaugggcucuggggcagguagg

SEQ ID NO: 6525 - RNA, 62 nt, Human
uugcacaauauuucuuuuguuguacuuuauaucuuguuuacaauaaagaauucccuuuggug

SEQ ID NO: 6526 - RNA, 62 nt, Human
uugcacauccacuggaaaggugucauuaaugacccaguguuagaaugcaagaggucagguua

SEQ ID NO: 6527 - RNA, 62 nt, Human
uugcacauguucaauuugugucagcagcucuuuuauaagcuaacaugugcuagcauucauuu

SEQ ID NO: 6528 - RNA, 61 nt, Human
uugcacgggguugauuaauuucugcacagggagugagauuauuaaaguaacacacacacaa

SEQ ID NO: 6529 - RNA, 64 nt, Human
uugcacuuaaaugaacaugcccauucucaguagcugaugcaguaauauauucaguuuaucuaug

SEQ ID NO: 6530 - RNA, 61 nt, Human
uugcagcugcccuucccuccccguuuuucauggccugcugaaauaugugugugaagaauua

SEQ ID NO: 6531 - RNA, 61 nt, Human
uugcauggugggaucucuggccccucagggacuugagauuauuuaaguacuaguuccuaac

SEQ ID NO: 6532 - RNA, 63 nt, Human
uugcauuugcuuggcuccuaguaacaauucuuuuacaguauuagcacucucuuuacuaaggaa

SEQ ID NO: 6533 - RNA, 64 nt, Human
uugccaacuguauauuuauguaauaagugcaauaaaaugcaguaaauuuuaaaauucucuuaag

SEQ ID NO: 6534 - RNA, 64 nt, Human
uugccacauggagagagacugugaggacagaagccaaacuggaaguggaggagccaagggauug

SEQ ID NO: 6535 - RNA, 62 nt, Human
uugccacugaggaguuggagggagggcaagacgacaguguuaagucagaucauuuaaugguu

SEQ ID NO: 6536 - RNA, 61 nt, Human
uugcccauauugcacuuugauuucaaacuaugcacugugaagagauuuuuuuccccaggua

SEQ ID NO: 6537 - RNA, 62 nt, Human
uugcccgcccacguuuuucucacucuuccggguugugcaauaacucucccagccaguggucc

SEQ ID NO: 6538 - RNA, 64 nt, Human
uugcccucucccuaacggggagaaaucgagccacccaacuggaaucagagggucuggcuggggu

SEQ ID NO: 6539 - RNA, 62 nt, Human
uugcccuuugcuugaauuccuggaaugcauacauauaagcuaaacagaugucugcaguuaua

SEQ ID NO: 6540 - RNA, 62 nt, Human
uugccuaaaagaaaggacugacaagugugcaaaauguuuacaaucuuuugugaaauuguagu

SEQ ID NO: 6541 - RNA, 61 nt, Human
uugccucauggccagcgccccucagccucugccacugugaaccggcucccacccucaaggu

SEQ ID NO: 6542 - RNA, 61 nt, Human
uugcuaaaagaagagaggggaagaauuuaauggacugugaauuucaaaaaaaaaaaaaaag

SEQ ID NO: 6543 - RNA, 62 nt, Human
uugcuccucgcugcucccauuagcuggugcaggcuuccguuaaggggucccucccuuggccu

SEQ ID NO: 6544 - RNA, 63 nt, Human
uugcucuuugaaccacagcuuuauuaugguccuuuacacuggagacagacacagagacacugu

SEQ ID NO: 6545 - RNA, 63 nt, Human
uugcucuuuuugggaugccugaugucucaucacggcaguauuaucucucugggaccucugaca

SEQ ID NO: 6546 - RNA, 62 nt, Human
uugcugacaggaggaggaaguaguggagaucauuucaucucagucacgucuguuucucacuu

SEQ ID NO: 6547 - RNA, 61 nt, Human
uugcugcagaguuucuuucaaaucugaguguugccugcugaacucggaggggaguuuggag

SEQ ID NO: 6548 - RNA, 63 nt, Human
uugcugcagcucguuucuuuccaauaaaaguuucugugacuuaggaggaggagccgaggcccc

SEQ ID NO: 6549 - RNA, 63 nt, Human
uugcugugacacccugaaaaagcugaccacaaaugcaguauuaucuugacauaccucuguccc

SEQ ID NO: 6550 - RNA, 61 nt, Human
uugcuuaaaacgucuaccuauuccauuuaauuuccugcugauaaauguauuuuaucuacaa

SEQ ID NO: 6551 - RNA, 63 nt, Human
uugcuuauacuccaucacauucagaugucuugguugugacuuauuaccaguguggcagagaac

SEQ ID NO: 6552 - RNA, 62 nt, Human
uugcuuauuacauuuaaauccuuguguaacugaauguuuacaugucaagaggaaaagcugua

SEQ ID NO: 6553 - RNA, 61 nt, Human
uugcuuccuacaccacguccuugaguggaguucccugcugaagccccuagcacacacugca

SEQ ID NO: 6554 - RNA, 62 nt, Human
uugcuugccuaaaucuuuugaucuuauauuucucucaucucagagccuguccugaguuguaa

SEQ ID NO: 6555 - RNA, 64 nt, Human
uugcuugggaaggggccuuugucuugucaagguuccaacuggaaacccuuaggacagggucccu

SEQ ID NO: 6556 - RNA, 61 nt, Human
uugcuugggcugcuuggcuaugcaagccuccugccugcugauggccacuucagggacagcc

SEQ ID NO: 6557 - RNA, 63 nt, Human
uuggaaaacaaaaguuuuaauuaaaaaaaauccuugugacuuacaauuugcacaauauuucuu

SEQ ID NO: 6558 - RNA, 63 nt, Human
uuggaaacucagcacauuugaacuuggguuugauucaguauuaacagaucuugacuacacuaa

SEQ ID NO: 6559 - RNA, 61 nt, Human
uuggaaagugggcuguggugcccauuugcagugacugugaagugacuccaggacggaccug

SEQ ID NO: 6560 - RNA, 62 nt, Human
uuggaaucaaguaugaaaaucugcacaaaugcaauguuuacaagaacugguugauucuggga

SEQ ID NO: 6561 - RNA, 61 nt, Human
uuggaauuugguaaaauuuuaauguugauuuuuacugugaaaagguuuuuauaagauauac

SEQ ID NO: 6562 - RNA, 63 nt, Human
uuggaggucuggauccagucucucuuuguuuuaaugugacuuaggugcugucaacauuagcaa

SEQ ID NO: 6563 - RNA, 62 nt, Human
uuggauacucugugccaauuuauuuauagucaaguguuuacacuuuuuccuguggaauaauu

SEQ ID NO: 6564 - RNA, 62 nt, Human
uuggauuaaauggggcugcuaagaggggggaaauaugaaggaaugaagggacagcauuggaa

SEQ ID NO: 6565 - RNA, 61 nt, Human
uuggcaaaacccauuccccaaagcuacgcuuccccugcugagauagccccuacccccaccu

SEQ ID NO: 6566 - RNA, 64 nt, Human
uuggcaauauuucaguuaguuaaauaccuguagccuaacuggaaaauucaggcuucaucaugua

SEQ ID NO: 6567 - RNA, 62 nt, Human
uuggcagggguauuaaacgugcauuuuuacucaacuaccucagguauucaguaauacaauga

SEQ ID NO: 6568 - RNA, 61 nt, Human
uuggccagcacacacuuuccuccugcagcacccccugcugaaggggucccccauuguuuug

SEQ ID NO: 6569 - RNA, 62 nt, Human
uuggcccgaaagcaguaaaaauuguucauuaaucuuccguuaggccaauaaaagaagggccu

SEQ ID NO: 6570 - RNA, 61 nt, Human
uuggccugaaauggaccucuccagcucuggcuuccugcugagucccucacguuucuucccc

SEQ ID NO: 6571 - RNA, 62 nt, Human
uuggcgcugagauccaggcuggauccauugcuuuuguuuacaauaggcacucucucuacccc

SEQ ID NO: 6572 - RNA, 64 nt, Human
uuggcgucccugaaagggaggaagaaaaagcaagcaaacuggaaaacguauuucaggauaucac

SEQ ID NO: 6573 - RNA, 63 nt, Human
uuggcuacugguguauguagcaguucuuaaaucagcaguauuaugaaaaaaaauucccccuca

SEQ ID NO: 6574 - RNA, 62 nt, Human
uuggcuucuucuuuaggauugugaugguucguucuguuuacaucaguuuuaacgagagguau

SEQ ID NO: 6575 - RNA, 62 nt, Human
uugggaaugucuuccacaggauuugagaauaguuucaucucagcccccauuagagagaaguu

SEQ ID NO: 6576 - RNA, 64 nt, Human
uugggaauuaacggcaacaccugacaacacaacacaaugcaguagccaucaagcaggaagcccg

SEQ ID NO: 6577 - RNA, 61 nt, Human
uugggacccuccagugcuggauuugaugaguuaacugugaaauaccacaagccugagaacu

SEQ ID NO: 6578 - RNA, 64 nt, Human
uugggaccuuuaaagagccccuccuaacccagcaguaacuggaacacacuugggagcaguccua

SEQ ID NO: 6579 - RNA, 62 nt, Human
uugggcauuugaacuuuguuuuucuuuaaagaaaugcugcuauuaaacauauuuguaaaugg

SEQ ID NO: 6580 - RNA, 62 nt, Human
uugggccugucaccccuuggauggguuccuaguuuguuuacauuuuccugaacccuccugag

SEQ ID NO: 6581 - RNA, 62 nt, Human
uugggcuacuuccaccuuuugccuauugaaauaaugcugcuaugaagaugaguguacaagug

SEQ ID NO: 6582 - RNA, 64 nt, Human
uugggcuggaugguguuggggcaugauguguggaggaacuggaaggugcuuuaggucugguuca

SEQ ID NO: 6583 - RNA, 61 nt, Human
uugggcuguuugagagcauaauuaugguaaucaugagauuaauguuucaugauuucuaccu

SEQ ID NO: 6584 - RNA, 62 nt, Human
uuggggaagucucuuuuuugaaacacuucagaacugcugcuauaaagaaauucucuaauugg

SEQ ID NO: 6585 - RNA, 62 nt, Human
uuggggaucagggucagugugagcagcuaacauccuaccucaaauggaacaggauuuuuuga

SEQ ID NO: 6586 - RNA, 63 nt, Human
uuggggcuggaaugaaaggccgugaaucuggaaacacacuggaaccgaucaacgcuaucagcc

SEQ ID NO: 6587 - RNA, 61 nt, Human
uuggguagguccuuuggaguucuagacucaguuugagauuacagaagauaugcucaacauc

SEQ ID NO: 6588 - RNA, 64 nt, Human
uuggguccauuugcuacugccuagucuugguuccuuaugcaguauuauagggcagccuuuuuag

SEQ ID NO: 6589 - RNA, 62 nt, Human
uugguacaguuacuuuagcuauuuauuaacuugcucaucucauagaacauuuuaguagauuu

SEQ ID NO: 6590 - RNA, 64 nt, Human
uugguaguagguauuucgugagaaguucaacaccaaaacuggaacauaguucuccuucaagugu

SEQ ID NO: 6591 - RNA, 64 nt, Human
uuggucauagcauucacuuuugcuauuccaaucuacaacuggaagauacauaaaagugcuuugc

SEQ ID NO: 6592 - RNA, 62 nt, Human
uuggugaaggcaagucucugaaagcagaacuauccaguguuaucuaaaaauuaaucugagca

SEQ ID NO: 6593 - RNA, 62 nt, Human
uuggugaguuuaguugugcaugccuuuguuguauauaagcuaaauucuagugacccaugugu

SEQ ID NO: 6594 - RNA, 62 nt, Human
uuggugccaaaauauuuucaguuguacuguagauuguuuacaugugaagugccuguguaauu

SEQ ID NO: 6595 - RNA, 62 nt, Human
uugguggacucucuggugaggggugggcagaacuugcugcuacuagaguucuuggguucucc

SEQ ID NO: 6596 - RNA, 63 nt, Human
uugguggauguagcacaauuuccacacugugaaggcaguauuagaagacuuaauuguaaaagc

SEQ ID NO: 6597 - RNA, 62 nt, Human
uuggugguucugcugugucugggauaaccucggcuguuuacaguguggcccggagcgucuug

SEQ ID NO: 6598 - RNA, 62 nt, Human
uugguguauguaagcacauuuguuccuuuauaucuguuuacaaaacugugaaucaaaaagac

SEQ ID NO: 6599 - RNA, 62 nt, Human
uugguuaaaaggguucuuuguucccauccagccgaugaaggagcaaacgucuggcuauguga

SEQ ID NO: 6600 - RNA, 62 nt, Human
uugguugaaaauuguacuugaauacauacaugcaugcugcuaaacuagaacuuuaauuuuuc

SEQ ID NO: 6601 - RNA, 62 nt, Human
uugguugcuggaaaaaucuuuggggaaagcugguauaagcuacacacugaccuguccccagu

SEQ ID NO: 6602 - RNA, 62 nt, Human
uugguuuuacaggucauuaccagucauuaaaguccaguauuacuaagguaagggauugagga

SEQ ID NO: 6603 - RNA, 62 nt, Human
uuguaaaauggggcuaaugucaccugccucuuaccuaccucagagggauuuggugaagcaaa

SEQ ID NO: 6604 - RNA, 62 nt, Human
uuguaagcuuggauuuuuaggucuagcaauacacuguuuacaagagcaucaccuaaaaugug

SEQ ID NO: 6605 - RNA, 62 nt, Human
uuguaauagauguuugauagauuuucugcuacuuugcugcuaugguuuucuccaagagcuac

SEQ ID NO: 6606 - RNA, 62 nt, Human
uuguaaugcacauggcaaagcaaagacguuugugaugaaggaacugcucaucuaagcaaaag

SEQ ID NO: 6607 - RNA, 62 nt, Human
uuguaccucucaguuucagucagggacauauuuugugcaauauuucugugauugugccuaug

SEQ ID NO: 6608 - RNA, 62 nt, Human
uuguaccucucauuuucagucagggacauacuuugugcaauauuucugugauugugccuaug

SEQ ID NO: 6609 - RNA, 62 nt, Human
uuguacuaaauaaugaugaccucugcuggauuucuguuuacauccagaaaacaauguuaagg

SEQ ID NO: 6610 - RNA, 63 nt, Human
uuguagaaaguuguggcuagaucucauaaauauaacaguauuaaggccauaaaauuugguuaa

SEQ ID NO: 6611 - RNA, 62 nt, Human
uuguagacucacaaguuuaacuguuguauuauaacaguauuacaugucaacggugugguuau

SEQ ID NO: 6612 - RNA, 64 nt, Human
uuguaguccagguugcccgccacaucgauggaggcgaacuggaacaucugguccaccugcgggc

SEQ ID NO: 6613 - RNA, 62 nt, Human
uuguauacacauuugcauauacccacauggggacauaagcuaauuuuuuuacaggacacaga

SEQ ID NO: 6614 - RNA, 64 nt, Human
uuguauacauccuggguaaugagagguggcuuuugcggccaguauuagacuggaaguucauacc

SEQ ID NO: 6615 - RNA, 61 nt, Human
uuguauggagaacucaccaagaaagaauucaauacugugaaauaugcagcaagaagauugg

SEQ ID NO: 6616 - RNA, 63 nt, Human
uugucaacguucuuuccaaauacauggaaggacucacacuggagauaaacccuuuaaguguaa

SEQ ID NO: 6617 - RNA, 64 nt, Human
uugucacaaacccuuggagucauucccagauaauagaacuggaaaugauaaauccccuaaugcc

SEQ ID NO: 6618 - RNA, 64 nt, Human
uugucauugucugaccaaaauuccuucugcacaugaggccaguauaggcaacgucacauuuguu

SEQ ID NO: 6619 - RNA, 62 nt, Human
uuguccagcuuuuuauuccagucauaauaggugacaguguuaaccgugaaaacuugagaggc

SEQ ID NO: 6620 - RNA, 62 nt, Human
uuguccaugaggagaaaaaaagcaugugucaugcaugaaggaaacugaacuugagguggccu

SEQ ID NO: 6621 - RNA, 64 nt, Human
uugucccuuuaaaacugcuguaccuguaugauaaagaugcaguaccuuucucuuaaaaaaaaau

SEQ ID NO: 6622 - RNA, 62 nt, Human
uugucucauagggauuguccccuugaacauccagcaguguuauuuuacagaagacaaauuaa

SEQ ID NO: 6623 - RNA, 62 nt, Human
uugucuccauuauguuccagaggcaguauaugcagugcaauaauuuuuucauuccacuuaug

SEQ ID NO: 6624 - RNA, 62 nt, Human
uugucuuuuaaaaugcuuccaacccaaaggccuuucaucucaauaucugucaaacuugaaua

SEQ ID NO: 6625 - RNA, 62 nt, Human
uugugaaaauuucagaaacaauagauucuuaaagauaagcuagcuaugucuaggagcuuuau

SEQ ID NO: 6626 - RNA, 63 nt, Human
uugugaaauguauuaaguugugguucuuauugaaacaguauuauauaauguuugcuuaauuau

SEQ ID NO: 6627 - RNA, 61 nt, Human
uugugacucaccauucaaggccccgagucuuggacugugaagcaucugccauggggaagug

SEQ ID NO: 6628 - RNA, 62 nt, Human
uugugaggguacucugucuaauguauauuucuaguguuuacagacaguaaauguguauaugu

SEQ ID NO: 6629 - RNA, 61 nt, Human
uugugauccacucgccucagccucucgaagugcugagauuacacacgugagcaacugugca

SEQ ID NO: 6630 - RNA, 61 nt, Human
uugugaucgguaggcaguucagagcauaaguuaacugugaaaaaaauguaaagguuuuauu

SEQ ID NO: 6631 - RNA, 63 nt, Human
uugugcagagggacaaagccacagccacacucuucaacgguuaccaaacuguuuuuggaaauu

SEQ ID NO: 6632 - RNA, 63 nt, Human
uugugcaguuugaagauaguccauauuuccuauuucaguauuagguccugcaacacuuuucaa

SEQ ID NO: 6633 - RNA, 62 nt, Human
uugugcaguuuuuuaacuagggaaagcuuuguacugcugcuaaugauaugcacccagaaacc

SEQ ID NO: 6634 - RNA, 62 nt, Human
uugugcauuuguuauggaaauuuaauucauaugguguuuacaguacuacuuuuguaacuucc

SEQ ID NO: 6635 - RNA, 62 nt, Human
uugugcgauagaacauaauugcaggaguacugucucaucucaucauauucacggguucugga

SEQ ID NO: 6636 - RNA, 63 nt, Human
uugugcuguuagggcaaguuacguucagcacaugaacacuggacccugcuuugccuguccguc

SEQ ID NO: 6637 - RNA, 49 nt, Human
uuguggauuuaaucucuaagguguuuacauuuaaaggcuagcguucauc

SEQ ID NO: 6638 - RNA, 62 nt, Human
uuguggggcauguuaaguuacaguuugcacaaguucaucucauuuguauuccauugauuuuu

SEQ ID NO: 6639 - RNA, 64 nt, Human
uugugugaguguuuauauagaaaugaacauagaccuggccaguaaaaggcucugaggaggcuua

SEQ ID NO: 6640 - RNA, 62 nt, Human
uuguguggcuuagauacaacaugguucugguaccaugaaggauucugguaccaugaaaguuu

SEQ ID NO: 6641 - RNA, 62 nt, Human
uuguguguuacauguaacagacaugguaaauauuuguuuacagucuuuguuuaacaaaccau

SEQ ID NO: 6642 - RNA, 62 nt, Human
uuguguguuuuuacuuuuuggcuacucugaaugaugcugcuaugaacauauuucuacaagau

SEQ ID NO: 6643 - RNA, 62 nt, Human
uuguuaacccuuauccauuuguugacauguagacuguuuacaaaaaaaaaacacaugguuaa

SEQ ID NO: 6644 - RNA, 62 nt, Human
uuguuaguuuaacacagccguauuuuuggacauucaguguuacuugcugagucugacagccu

SEQ ID NO: 6645 - RNA, 62 nt, Human
uuguuauaccacagauuuuucuugcauuagggcacaguguuaaauuuuuuggagguaaauau

SEQ ID NO: 6646 - RNA, 61 nt, Human
uuguuauucaaaucaaguucuaguguuuuuaugugagauuauauaauuuacaguguuguuu

SEQ ID NO: 6647 - RNA, 62 nt, Human
uuguuccaugagcagaaaacuggagcucuggccucaguguuacagcuaaauaaucuuuaauu

SEQ ID NO: 6648 - RNA, 64 nt, Human
uuguucugucccuggggugugugaauuccuaccccgaacuggaagccgggaguggcagacagaa

SEQ ID NO: 6649 - RNA, 62 nt, Human
uuguucugugugugaggucugagcucugaggcagcaguguuagcacaauaaagaaacauuga

SEQ ID NO: 6650 - RNA, 63 nt, Human
uuguucuuuguggucugacucuaugaucgaucacagugacuuagauucaggaaagaacauuaa

SEQ ID NO: 6651 - RNA, 63 nt, Human
uuguugccuucagccggcuucccugagggaggagaacacuggauuauuggaaauguuuuaauc

SEQ ID NO: 6652 - RNA, 62 nt, Human
uuguuggggcuucccugccccuccuggucugugucaguauuaccaccagacugacuccagga

SEQ ID NO: 6653 - RNA, 62 nt, Human
uuguuguaguugaacagcaacuguuuuuuucccucaguguuaacgaaaggauaaagacuacc

SEQ ID NO: 6654 - RNA, 62 nt, Human
uuguugugacucauuaauugccgugcagcucaucauaagcuaccuauuggccacuggcuuua

SEQ ID NO: 6655 - RNA, 62 nt, Human
uuguuuacaacucaaaacuuugaguuuuacacuuuguuuacaguagauaauuuuuuuuccuu

SEQ ID NO: 6656 - RNA, 61 nt, Human
uuguuuaugguggaaaauuacugaaacuauuuuacugugaaacagugugaacuauuauaau

SEQ ID NO: 6657 - RNA, 64 nt, Human
uuguuucauugaaaaaacaaauugauaaacauauuaaacuggaagaauuuucuuuauucaaaug

SEQ ID NO: 6658 - RNA, 62 nt, Human
uuguuucucaagcucagugcauagugguaaauuucaguguuaacauuggagacuugcuuuuc

SEQ ID NO: 6659 - RNA, 62 nt, Human
uuguuugucucuccuuuucuuuuguuacuguucuugcugcuagaacuuuuuuaaauaaacuu

SEQ ID NO: 6660 - RNA, 61 nt, Human
uuguuuguuaagcggggccuugggcaguguuuuccugcugagggugguuuuacauuuuuuu

SEQ ID NO: 6661 - RNA, 61 nt, Human
uuguuuuaguuuucaguaauuuaacaaagggagccugcugaauaacaaaauuaaaaugaug

SEQ ID NO: 6662 - RNA, 64 nt, Human
uuguuuuaugaaagguacuauuccuucuuucacauuaacuggaaaccucuuuuuuuaccuguug

SEQ ID NO: 6663 - RNA, 61 nt, Human
uuguuuucccuugaacuugguuagaauugugcuacugugaacgcugauccugcauauggaa

SEQ ID NO: 6664 - RNA, 61 nt, Human
uuguuuucuacagcuugaggaaagagcuggcaaacugugaaucuaacuugaucuuguugcc

SEQ ID NO: 6665 - RNA, 61 nt, Human
uuguuuuuaaucuccuguuuguugagugcacugacugugaaaccuuuaccuuuuuuguugu

SEQ ID NO: 6666 - RNA, 62 nt, Human
uuguuuuuuaaaggcucaaucaaggaagugaggugugcaauaagguagcaaguaaaacgcag

SEQ ID NO: 6667 - RNA, 64 nt, Human
uuguuuuuucaucccccagcacacuauaauauagugaacuggaaaagucccuuccagaaacagc

SEQ ID NO: 6668 - RNA, 61 nt, Human
uuuaaaaacuuacuuauuuggguaguuaaauuuugagauuaugcauagaaagaauccaugc

SEQ ID NO: 6669 - RNA, 62 nt, Human
uuuaaaacauaauugccaauugaaacccuaaauauguuuacauaccauuaagauaugauuca

SEQ ID NO: 6670 - RNA, 61 nt, Human
uuuaaaacuuugguuuccuucuauccaccaaauacugugaauuguuuuuccauuuauuuuu

SEQ ID NO: 6671 - RNA, 62 nt, Human
uuuaaaauggggaugaugaugauaacaauaauaccuaccucacaagguuguugugagcauca

SEQ ID NO: 6672 - RNA, 63 nt, Human
uuuaaaauugaaauuaguuauuuucuucugcuggacaguauuaaauagagcaggauguugagu

SEQ ID NO: 6673 - RNA, 64 nt, Human
uuuaaaauuuauuauuuugaucuugaauuauuuauaaacuggaaagugguuugauuauugugag

SEQ ID NO: 6674 - RNA, 62 nt, Human
uuuaaaauuuccagaauuuuaagcaaaaagcauuaugaaggaaggcuugguuuaauaaagac

SEQ ID NO: 6675 - RNA, 62 nt, Human
uuuaaacauuuuuaaucacaagcuguauuagcuuugcugcuauauagguguuauguguaaau

SEQ ID NO: 6676 - RNA, 64 nt, Human
uuuaaagaaagacuuuaacaggugucaugaagaacaaacuggaauuucauucugaagcuugcuu

SEQ ID NO: 6677 - RNA, 62 nt, Human
uuuaaaggacuugucuucuauaccacccuuguccucaucucagguaauuuaugaaaucuaug

SEQ ID NO: 6678 - RNA, 63 nt, Human
uuuaaaguucuccuuccgucuuuucucccauuuuacaguauuacucaaauaagggcacacagu

SEQ ID NO: 6679 - RNA, 62 nt, Human
uuuaaauagccagcauguaauacaaguaacuacacuaccucauaucuacaugauuuucaagu

SEQ ID NO: 6680 - RNA, 64 nt, Human
uuuaaauauguaugaaugccagaaauuugucaguucaugcaguaggauaaaaaaaaaaaaaaaa

SEQ ID NO: 6681 - RNA, 61 nt, Human
uuuaaaucaguugauuaauuaauuaacucaaauacugugaacuaucucuaaaacacuagaa

SEQ ID NO: 6682 - RNA, 63 nt, Human
uuuaaaucauucuuguugaacaguuuuuguauguacaguauuaugguacuuuuuuuuuuuuag

SEQ ID NO: 6683 - RNA, 62 nt, Human
uuuaaaucuccaacuugcuguuuccaaaaagaaggugcaauaucauauaucaucaguuagca

SEQ ID NO: 6684 - RNA, 62 nt, Human
uuuaaaugaagaaauuagugaaaaaauugaccuaaugaaggaaacauuugugcuuuccuaua

SEQ ID NO: 6685 - RNA, 63 nt, Human
uuuaaaugacagcaccugagaagaggaaccguuuuacacuggauguuucucauguagaacaag

SEQ ID NO: 6686 - RNA, 64 nt, Human
uuuaaauguauauguuauuuuuggcuauucaucuaaaugcaguagacauguugaucgguguuuu

SEQ ID NO: 6687 - RNA, 62 nt, Human
uuuaaauuaaauucggguaauauuaaacaguacauguuuacaauaccaaaaaagaaaaaauc

SEQ ID NO: 6688 - RNA, 64 nt, Human
uuuaaauuuacugaccaaagcauguuuuaagcugcaaugcaguagucacgggugguaaccaugu

SEQ ID NO: 6689 - RNA, 61 nt, Human
uuuaacaauggcagaaguuuacuaugcgcaaauacugugaaaugcccgccaguguuacagc

SEQ ID NO: 6690 - RNA, 61 nt, Human
uuuaacuaccaugcccuugauauaucuuuugcaccugcugaacuucauuucuguaucaccu

SEQ ID NO: 6691 - RNA, 64 nt, Human
uuuaaguauuggaauuucacaaaagacauaggacuuaacuggaaaaugaaaaaaaaaagaaaaa

SEQ ID NO: 6692 - RNA, 62 nt, Human
uuuaagucuuauuuuuacuguuuauauauuugaaugcugcuacaacagaugaucuucauccc

SEQ ID NO: 6693 - RNA, 63 nt, Human
uuuaaguuauaaggugaaucaaacaauauguaauacaguauuaggauguaaucuuugcuuuug

SEQ ID NO: 6694 - RNA, 62 nt, Human
uuuaaguuuucuuucuguuucuaagacaacaguaugcugcuauagccgucugcuaccucgag

SEQ ID NO: 6695 - RNA, 62 nt, Human
uuuaaucuguguuucugcaagugccauccuuguacaguguuaagaggguaacauggguuacc

SEQ ID NO: 6696 - RNA, 64 nt, Human
uuuaaucuuuuuaaagagugugugaaaauucacuuuaacuggaauuuuaacaggcaagccggca

SEQ ID NO: 6697 - RNA, 63 nt, Human
uuuaaugacgguuuaaaacuuuuuaaaagaaaacucaguauuauuuuugcauguuuucuaacc

SEQ ID NO: 6698 - RNA, 62 nt, Human
uuuaauuaaauaggccaaauuuuugcugcuuaggucaucucaaggcugauacuugagcugug

SEQ ID NO: 6699 - RNA, 64 nt, Human
uuuacaaaugaaguauuucauguaauauaagugaacaacuggaaauaaaguaggaaagaauuug

SEQ ID NO: 6700 - RNA, 62 nt, Human
uuuacaacuuacauuuacaauuuauaguguuuaccaguauuaaauucucagccacuccuuuc

SEQ ID NO: 6701 - RNA, 62 nt, Human
uuuacaagacugcuuuuaccuuaaacuuuguagauguuuacaucuuuuuguuguguuuuaag

SEQ ID NO: 6702 - RNA, 62 nt, Human
uuuacaaguaauaucagaaaguugaaggaaccaguguuuacaaguaauaccagaaaguugcc

SEQ ID NO: 6703 - RNA, 62 nt, Human
uuuacaaguccagauucaaaaaauguuuuuacuuuguuuacaacucaaaacuuugaguuuua

SEQ ID NO: 6704 - RNA, 62 nt, Human
uuuacagaauuaaaccccuucauuguaagggcuuuguuuacauauuaagugucaaguauuua

SEQ ID NO: 6705 - RNA, 64 nt, Human
uuuacaguguaccaaaugagaaugagguugaaauguaugcaguaagguacucaguaauuaauug

SEQ ID NO: 6706 - RNA, 64 nt, Human
uuuacaucauuucacggaaacacaucuuuguuuguaaugcaguauucuuucucuguguuugaca

SEQ ID NO: 6707 - RNA, 62 nt, Human
uuuacaugccacuauauugacuuuaauugauauacaguauuaaguuuuuaggugccauuauu

SEQ ID NO: 6708 - RNA, 62 nt, Human
uuuacccuuuguagcucagagagcaccugauguaucaucucaaacacaauaaacaugcuccu

SEQ ID NO: 6709 - RNA, 63 nt, Human
uuuaccuuagcagacaugcaaaagcuuauucuugugugacuuacuuucuuuaagcuaauaaua

SEQ ID NO: 6710 - RNA, 64 nt, Human
uuuacuucauguuuacaaauaacuguuugcuuuuuaaugcaguacuuugaaauauaucagccaa

SEQ ID NO: 6711 - RNA, 61 nt, Human
uuuacuuguuuacauguuugucuccccuucuagacugugaauccuuaagggcauggacugu

SEQ ID NO: 6712 - RNA, 62 nt, Human
uuuacuuuugucagaaucaaggcuucggccaccugugcaauauuuucccauggaaugcagca

SEQ ID NO: 6713 - RNA, 61 nt, Human
uuuagaaacaauuauuuuucccauuauuucuuaugagauuaguuguuucaaguaggagaca

SEQ ID NO: 6714 - RNA, 62 nt, Human
uuuagaagaucccuucucaaacucagaacccuagcaguguuaccuuaaacaaaaaugagcuc

SEQ ID NO: 6715 - RNA, 63 nt, Human
uuuagaaugcugaaauguuuuugaaguuaaauaaacaguauuacauuuuuaaaacucuucucu

SEQ ID NO: 6716 - RNA, 62 nt, Human
uuuagauggaaaauuaccucacaucuguuuucuucaguauuacuuaagauuguuuauuuagu

SEQ ID NO: 6717 - RNA, 62 nt, Human
uuuagauuaccucauuguccauuuugacucauguuguuuacaagugaaaauaaaaacacuug

SEQ ID NO: 6718 - RNA, 62 nt, Human
uuuagcccagauacacauacucuuuuuugucuuugugcaauaaucaguguuccuggcagagc

SEQ ID NO: 6719 - RNA, 62 nt, Human
uuuagucuuuuaagcaaaguuuacgaaugaagaaaugaaggauggccacaagcguaaggcau

SEQ ID NO: 6720 - RNA, 63 nt, Human
uuuagugggucuugauguagggugggcaagccccgacacuggagcuuagccugagaggguucu

SEQ ID NO: 6721 - RNA, 61 nt, Human
uuuaguucacuagguucuaggagugagcuggggccugcugagguggggguggggcugacuc

SEQ ID NO: 6722 - RNA, 61 nt, Human
uuuaguuguuuucacuaagucauuccuaccauaacugugaauuuaaaguaaaaccagcuca

SEQ ID NO: 6723 - RNA, 62 nt, Human
uuuaguuuaaauaaauugaaucauuuauaauaaucaguguuaacaauuuagugacccuuggu

SEQ ID NO: 6724 - RNA, 62 nt, Human
uuuauaaaaucuaaauuuggacuacuugcaaaugauaagcuauucuaguagccuuuaguuua

SEQ ID NO: 6725 - RNA, 64 nt, Human
uuuauaaguguucuauauguguaaaauaguauuuucaacuggaaaguguuggcuagugcaaaag

SEQ ID NO: 6726 - RNA, 63 nt, Human
uuuauaccaguggaucuggacccaagacauuacccacacuggaaggggauuuguauaauaaau

SEQ ID NO: 6727 - RNA, 62 nt, Human
uuuauacuauuagaauuaaaaaccagcugacugggugcaauacgggugaaaauacuugugac

SEQ ID NO: 6728 - RNA, 63 nt, Human
uuuauacugccgcuguaaaauuuaccacaaacuuagugacuuaacacaaauuuauugcaauuc

SEQ ID NO: 6729 - RNA, 61 nt, Human
uuuauacuugagaaaaauuguaccaauauaaagacugugaaaaagccauuaaugucugcuc

SEQ ID NO: 6730 - RNA, 61 nt, Human
uuuauacuugagaaauauuguacaaauauaaagacugugaaaaagccauuaauacaugcuc

SEQ ID NO: 6731 - RNA, 61 nt, Human
uuuauacuugagauaaauuauacaaauauaaagacugugaaaaagccaucauuaucugcuc

SEQ ID NO: 6732 - RNA, 62 nt, Human
uuuauaguaguuuuuuuguauuuuuuuguaaugacaguauuauguaaaaaauaaaguauuuu

SEQ ID NO: 6733 - RNA, 62 nt, Human
uuuauauaucacuauaaaauccaguugaccuggacaguauuauauguacauaucuauucuaa

SEQ ID NO: 6734 - RNA, 64 nt, Human
uuuauaucuguggaguaauagaaagcuccauuacucaacuggaaaggacccuaaugacagggca

SEQ ID NO: 6735 - RNA, 62 nt, Human
uuuauaugcacauaauaaccuguaccuauaaaucgugcaauaaccauaugcgacuauuuugc

SEQ ID NO: 6736 - RNA, 63 nt, Human
uuuauaugcauuuuuguagggaucagcuugguagacaguauuagcggagaaacaccuugaucu

SEQ ID NO: 6737 - RNA, 62 nt, Human
uuuauaugugagcgagcaagccggcaagcgagcacaguauuauuucuccauccccucccugc

SEQ ID NO: 6738 - RNA, 63 nt, Human
uuuauauguguacauauaauuuuuuuuucuuugccacacuggagcacaauguuucuauguaaa

SEQ ID NO: 6739 - RNA, 62 nt, Human
uuuaugaacaugaagaaacuuuaguaaauguacuuguuuacauaguuaugugaauagauuag

SEQ ID NO: 6740 - RNA, 64 nt, Human
uuuaugacauucucugucuacucagaucauagugaaaacuggaaacaaaaaaaaaaaacagccu

SEQ ID NO: 6741 - RNA, 62 nt, Human
uuuaugagaaaguucucauuuaaaaugagaucguuguuuacaguguauguacuaagcaguaa

SEQ ID NO: 6742 - RNA, 63 nt, Human
uuuaugauucugcuuuuaugugucccuugauaacagugacuuaacaauauacauuccucauaa

SEQ ID NO: 6743 - RNA, 62 nt, Human
uuuaugugaauguuuuugccauuuuuuuuuuguucuaccucaaagauaagacaguacaguau

SEQ ID NO: 6744 - RNA, 62 nt, Human
uuuauuaaaggcaugcagggauuaacaggacuucuguuuacaauggaaaucugaaauggaag

SEQ ID NO: 6745 - RNA, 62 nt, Human
uuuauuauagcaguaaucuuguguuucuccugaugugcaauaaaucaauaauucaccagcgu

SEQ ID NO: 6746 - RNA, 62 nt, Human
uuuauuuccaaauuguuaaagagccagccauugaugcugcuacaugaguuccaugcucaaga

SEQ ID NO: 6747 - RNA, 62 nt, Human
uuuauuuccuagagaauuuauuuuauaaauacuuuguuuacauuuuagauuguacuugucuu

SEQ ID NO: 6748 - RNA, 62 nt, Human
uuucaaauguuuaaauaaugucuauccauguaucaugaaggacaguaugcuucaaauugucu

SEQ ID NO: 6749 - RNA, 63 nt, Human
uuucaaccugcuucccagguggcccugaugcaccccaguauuagaguuuauugcuaaaaggaa

SEQ ID NO: 6750 - RNA, 63 nt, Human
uuucaagccuuuauagaaaagcuucuuuguggcuuacacuggaaauuaugaaagcaguuuuuc

SEQ ID NO: 6751 - RNA, 63 nt, Human
uuucaaggcaugagcugaacagcguugacacagccgugacuuacaauuaaacccuuucaauua

SEQ ID NO: 6752 - RNA, 62 nt, Human
uuucacaauggguucugcuggacagauaaugggccaguguuauugaggugaucaagaucugu

SEQ ID NO: 6753 - RNA, 62 nt, Human
uuucaccucuuuauuauucagagauguugaguuuaugaaggacucgguccuuuuugguucuu

SEQ ID NO: 6754 - RNA, 62 nt, Human
uuucaccugcaugcuucuucuuuuaccuuuuugucuaccucauagucccucucuccccuccu

SEQ ID NO: 6755 - RNA, 62 nt, Human
uuucagaagacauuucugaaaucuuauaagcuacuuaagcuacguugucaguuuuaucgcaa

SEQ ID NO: 6756 - RNA, 62 nt, Human
uuucagagcaaucuaaaagcgccaaaauucgcuauguuuacagugauacuauuaagaaaaug

SEQ ID NO: 6757 - RNA, 62 nt, Human
uuucagccagacagaggcauaauaaagugacugauguuuacagaacccaaaugaugucuucc

SEQ ID NO: 6758 - RNA, 64 nt, Human
uuucaggcuuuuaugaggaaagcguuucuguguagaaacuggaagcuguucagggcaucggcag

SEQ ID NO: 6759 - RNA, 64 nt, Human
uuucauaucaccuccaucccauaaaguuguacugugaacuggaagaugguggaauguuuuggaa

SEQ ID NO: 6760 - RNA, 61 nt, Human
uuucauguaaucauaaagaccaguauauucccuccugcugaaugacaugcgacuguaaagc

SEQ ID NO: 6761 - RNA, 62 nt, Human
uuucauguaucauuauuuuuacaaggaacuauauauaagcuagcacauaauuauccuucugu

SEQ ID NO: 6762 - RNA, 61 nt, Human
uuucauguucuaugaggaauuuaguaccucuucacugugaaauucgaaauaaugauuuuua

SEQ ID NO: 6763 - RNA, 62 nt, Human
uuucauuccuuauugaacuuauuuugcacaauaguguuuacaaaucuuauacaucuuacuuu

SEQ ID NO: 6764 - RNA, 62 nt, Human
uuucauuuuccgacaacaucaaacuaacaagaggcaguguuaaauauuuuaaauggugcuau

SEQ ID NO: 6765 - RNA, 63 nt, Human
uuucauuuugcguuuuagcuagagaaguuuuccuugugacuuacuaauggcugcaaugccaau

SEQ ID NO: 6766 - RNA, 61 nt, Human
uuuccacaguuuuacauucaugugguuuucuccacugugaacucugugauucagaaucaga

SEQ ID NO: 6767 - RNA, 62 nt, Human
uuuccacccugaaaggaaauguuuuucuuugcagcaguauuagauaaugaaaaaugcuaauu

SEQ ID NO: 6768 - RNA, 63 nt, Human
uuuccagauuaccaaucaauuaaucaacaaauagccaguauuaugcuguguauuucugucagg

SEQ ID NO: 6769 - RNA, 64 nt, Human
uuuccagggaagcugggggaacugccacaucugaggaacuggaauaaagaugagggggcuucgg

SEQ ID NO: 6770 - RNA, 61 nt, Human
uuuccaguauucaguaguaaaauuuuccuguccacugugaaucaaagccugagucacucua

SEQ ID NO: 6771 - RNA, 62 nt, Human
uuuccagucagaugaggcaaacagcaagaguaagcaguguuacuugcagguacuuugguuaa

SEQ ID NO: 6772 - RNA, 62 nt, Human
uuuccaucuaccaaauggguguaauaauacuuaccuaccucacaggacuguugugaggcuug

SEQ ID NO: 6773 - RNA, 62 nt, Human
uuucccaagacauuuucagacuuaaaaauaaagucaguguuacagguggguuuagucccugc

SEQ ID NO: 6774 - RNA, 62 nt, Human
uuuccccaaagcaaagucuugugggaucgauuccuguuuacagggguugucucucuaaaugu

SEQ ID NO: 6775 - RNA, 62 nt, Human
uuucccgugcucuuugggcuccccagagaccugacaguauuagggagugaagggaggagggg

SEQ ID NO: 6776 - RNA, 62 nt, Human
uuucccugaggcccuaugagggcauggacagaaaaugaaggaugcaaccacccaggacagcu

SEQ ID NO: 6777 - RNA, 61 nt, Human
uuucccuuucacuggcaugggagacccuugacaccugcugagaaaacaugccucugccaaa

SEQ ID NO: 6778 - RNA, 64 nt, Human
uuuccggaagggcuccauacugucccaauaaggugaggccaguagcaggaauaauaaaucccac

SEQ ID NO: 6779 - RNA, 62 nt, Human
uuuccuaaugucagaguagaagauuuuaugcugcuguuuacaaaagcccaauguaaugcaua

SEQ ID NO: 6780 - RNA, 62 nt, Human
uuuccuaauuuuauuuauuucauacuguaguguacaguauuauaguucuucaauauauagau

SEQ ID NO: 6781 - RNA, 62 nt, Human
uuuccuagauuuaugcuuuugggauacagaccuauguuuacaauauaauaaauauuauugcu

SEQ ID NO: 6782 - RNA, 61 nt, Human
uuuccucccugagacugugugggguucagucagccugcugaaauugcuuccacuuauuacc

SEQ ID NO: 6783 - RNA, 62 nt, Human
uuuccucuggauuaaaacuacggacuggggacaacaguauuaauucgauugaauguggcuga

SEQ ID NO: 6784 - RNA, 61 nt, Human
uuuccugcauuuuaaaaguaauaaaauauuauuugagauuauuuugaaauuaaauauccuu

SEQ ID NO: 6785 - RNA, 62 nt, Human
uuuccuuaauaagaaaaguaauuuuuacucugaugugcaauacauuuguuauuaaauuuauu

SEQ ID NO: 6786 - RNA, 63 nt, Human
uuuccuuacaggcuuucgagugcacaugagaaugcacacuggagagaaaccuuauaaauguaa

SEQ ID NO: 6787 - RNA, 62 nt, Human
uuuccuucuuucuuuucaccuuuagguuaauauccaguauuauguguuaucccuuuggauaa

SEQ ID NO: 6788 - RNA, 51 nt, Human
uuucgacaccucugccugaggccugcugcuagcccugccugguuccaccag

SEQ ID NO: 6789 - RNA, 61 nt, Human
uuucggaucuucugucccagauccugcucccucccugcugagccugggguuccccuggcau

SEQ ID NO: 6790 - RNA, 62 nt, Human
uuucuaaaaucaguuuucguuaaaguacuucuacuuccguuauuggauaugguaucuccuaa

SEQ ID NO: 6791 - RNA, 62 nt, Human
uuucuaaaugcaagucaagcuuuauuguuaggcuugcugcuacucauuaacccaaauauuug

SEQ ID NO: 6792 - RNA, 62 nt, Human
uuucuacaguugauauauuuguaacugguacaagaugaaggacagcagcuuuccaucccuag

SEQ ID NO: 6793 - RNA, 62 nt, Human
uuucuauucgggacaauaaaauguauuuugaaagugcugcuaacuauugaugcugacagugu

SEQ ID NO: 6794 - RNA, 62 nt, Human
uuucuccacccuaguuuauuuauuuauagauaucuguuuacaaagucuguaguaaauccuga

SEQ ID NO: 6795 - RNA, 62 nt, Human
uuucuccccuuuauugaccaauuaacugagcacuugcugcuauuucuagacaugaaauguca

SEQ ID NO: 6796 - RNA, 62 nt, Human
uuucuccuuuguagcaggaaauuacacccagcccucaucucaauuaaugcuaaauaaagcua

SEQ ID NO: 6797 - RNA, 62 nt, Human
uuucucuaccugcccuugggcucacuaauaucaccaguauuauuaccaagaaaauauugagu

SEQ ID NO: 6798 - RNA, 62 nt, Human
uuucucuccuucuaucuccagggccccaccaaucuguuuacauauuuauuauccuauggggg

SEQ ID NO: 6799 - RNA, 62 nt, Human
uuucucuguacagcuaaguuuucugauggaaucuucaucucaccccauuuucuuuuuaaccu

SEQ ID NO: 6800 - RNA, 61 nt, Human
uuucugaaaggaauguuacucaagcugccacucccugcugaagagcaggagggaacucuca

SEQ ID NO: 6801 - RNA, 62 nt, Human
uuucugaacagcaucuguaaagugacaguaaccccuaccucacaggguuguugugaggauua

SEQ ID NO: 6802 - RNA, 64 nt, Human
uuucugaacucaguacauguuaauauuuaaauaauuaugcaguaacuuucucugggucuguuug

SEQ ID NO: 6803 - RNA, 62 nt, Human
uuucugcccaggcccuuguucccggcagugugacuguuuacaugguuuggcaauagguuuga

SEQ ID NO: 6804 - RNA, 62 nt, Human
uuucuguauguaaaauaaccccuuauuagagagacaguguuauauguauuuacaaaauuaua

SEQ ID NO: 6805 - RNA, 64 nt, Human
uuucuguuacuuuaugauucucauuucaacaggaauggccaguaaaaguuguuuuauuuuuccu

SEQ ID NO: 6806 - RNA, 62 nt, Human
uuucuguucaaucucaggguaaccuucucccuugucaucucagccugagcccuggaggcugg

SEQ ID NO: 6807 - RNA, 62 nt, Human
uuucuguucaucuauucugucuaauucagugcuuuguuuacaacgaaugucuuacaaaugcu

SEQ ID NO: 6808 - RNA, 62 nt, Human
uuucuuaagcagaaaauauuguugagguuaccuuugcugcuaaagauccaaucuucuaacgc

SEQ ID NO: 6809 - RNA, 62 nt, Human
uuucuuacccaagcaagggucuuugaugggcacguguuuacagcgcugcugcauagucuugu

SEQ ID NO: 6810 - RNA, 64 nt, Human
uuucuuauauauauauugauuauuuguuuuacacacaugcaguagcacuuugguaagaguuaaa

SEQ ID NO: 6811 - RNA, 63 nt, Human
uuucuucagccaugacucacaacuaaaaacauaaaacacuggagguuaguggaggccccuccc

SEQ ID NO: 6812 - RNA, 62 nt, Human
uuucuuccuuuguaaaaugggguuacuacuggcccuaccucauauucuaugagaaugaguuu

SEQ ID NO: 6813 - RNA, 61 nt, Human
uuucuugaaagcauuuauuuuaagucuuuauuuccugcugaaaugaaguuucaugcuguca

SEQ ID NO: 6814 - RNA, 62 nt, Human
uuucuugaucacuuguauaggaaacaauauuuuccaguguuauuugcauauauauuuugucc

SEQ ID NO: 6815 - RNA, 62 nt, Human
uuucuuugcuuucagcccauguaaauaaauaauacaguauuaacauuuucgugcugcuuccc

SEQ ID NO: 6816 - RNA, 63 nt, Human
uuucuuuuuucuuuuuuuuuaaagaucaugaauuugugacuuaguucugcccuuuggagaaca

SEQ ID NO: 6817 - RNA, 62 nt, Human
uuugaaguauuuaagguucccguugcauuuguuuuguuuacagauaauuaccuacucuggcu

SEQ ID NO: 6818 - RNA, 63 nt, Human
uuugacgcccuguuuucaguggccuggggagguccacacuggaagucgaauuccagcucgccu

SEQ ID NO: 6819 - RNA, 62 nt, Human
uuugacucaauuacacucugacgcauuuuuagaagugcaauaucuuuuccuaccaaaagaac

SEQ ID NO: 6820 - RNA, 62 nt, Human
uuugacugauauuguaauuuucaaauguauaauauguuuacagaugugcccugcauuuaguc

SEQ ID NO: 6821 - RNA, 61 nt, Human
uuugacuuguauccucuccccucuucauacacuccugcugaaaaauguuaauccaaauaca

SEQ ID NO: 6822 - RNA, 62 nt, Human
uuugagauguugagaggaacaagaagguggaaggcaguguuauuuauuucuuucuauucuug

SEQ ID NO: 6823 - RNA, 62 nt, Human
uuugagauuuuauuuugugauguauugucuucugcaguauuaaagggaaagagauauuaaug

SEQ ID NO: 6824 - RNA, 64 nt, Human
uuugagcaugggaccagccucaggucuuaugcugggaugcaguagacaggagauggggaaauua

SEQ ID NO: 6825 - RNA, 62 nt, Human
uuugaggagcuuggccccucuguaagcaucugacucaucucagagauaucaauucuuaaaca

SEQ ID NO: 6826 - RNA, 61 nt, Human
uuugagggcaagcagacccuucuuccagcucggacugugaacuccacugcagccguaagga

SEQ ID NO: 6827 - RNA, 63 nt, Human
uuugaucuuuuucaagucuucugaaaggaaguagacaguauuacacccugaauaaauaaggug

SEQ ID NO: 6828 - RNA, 61 nt, Human
uuugaugaaaugagauauguccaaguaacguuaacugugaaguuacacacaguagcugacu

SEQ ID NO: 6829 - RNA, 61 nt, Human
uuugauuuuuuuguccuugagaaccuuguccucccugcugauuuguuucuaaaucaaaaga

SEQ ID NO: 6830 - RNA, 62 nt, Human
uuugcacagggagaauugaaacugaguauaaucaauaagcuagauacgaaaucaguuucuca

SEQ ID NO: 6831 - RNA, 61 nt, Human
uuugcauaauuaaacucuucagcuauuuagacuacugugaaauguuuugacuuguuguaac

SEQ ID NO: 6832 - RNA, 62 nt, Human
uuugcaugcuuucuuaauaaaaaaaaaaaaagaauguuuacaguuuuaucuugcaucacaga

SEQ ID NO: 6833 - RNA, 61 nt, Human
uuugcauguguucugauaaaaaucaauucuagcacugugaagcuucagacaccuugaaagu

SEQ ID NO: 6834 - RNA, 62 nt, Human
uuugcauugcuucaguuugccaaguguuuuuacaucaucucauuugaucucaaaacagcuug

SEQ ID NO: 6835 - RNA, 64 nt, Human
uuugccaauuaccaguagacacuaguggaaccaucuaacuggaacuuccucucuccuuccacuu

SEQ ID NO: 6836 - RNA, 64 nt, Human
uuugccaccuaaacgaucaguguggugcugcguucuggccaguaaauuccauguuuuuggcuau

SEQ ID NO: 6837 - RNA, 62 nt, Human
uuugccguguaugaggagugcuagaaaaugcaaagugcaauauuuucccuaaccuucaaaug

SEQ ID NO: 6838 - RNA, 61 nt, Human
uuugccucaguugagcaucuaggaaguauuaaaacugugaagcuuucucagugcacuuuga

SEQ ID NO: 6839 - RNA, 62 nt, Human
uuugcggaaauuaaccuguuuguaugccuggcuuuguuuacaaacauauaucuauaucuaua

SEQ ID NO: 6840 - RNA, 61 nt, Human
uuugcucaccagaucauuuucuugggaccuugaacugugaauguuuuguccuaaccauuua

SEQ ID NO: 6841 - RNA, 62 nt, Human
uuugcuggcuucagaagccuuuguacauaagagaugcugcuacccaagcaccaaagaccugu

SEQ ID NO: 6842 - RNA, 62 nt, Human
uuugcugugcuguacauuacuguauguauaaauuaugaaggaccugaaauaagguauaagga

SEQ ID NO: 6843 - RNA, 61 nt, Human
uuugcuguguuucucugcuaccuaaucucagugacugugaaaggacauugugucugagcca

SEQ ID NO: 6844 - RNA, 64 nt, Human
uuugcuuuauaagugaggguagggugagggaggacaggccaguagggggagggaaagggagagg

SEQ ID NO: 6845 - RNA, 61 nt, Human
uuuggaacaaaucgcuucgccuuuuucuacuugccugcugaagcuuuggagcacuugugau

SEQ ID NO: 6846 - RNA, 64 nt, Human
uuuggagcagcagucuuaaauggaccauuuagggcaaacuggaacauauggacacccuaacauu

SEQ ID NO: 6847 - RNA, 62 nt, Human
uuuggauuauuuauguuuauaaaugauacagaucuguuuacaagguuuguagauacuuuuuu

SEQ ID NO: 6848 - RNA, 63 nt, Human
uuuggcaaagaacaaagacccaaagcugucagaaaacacuggauaaaugaaggaguaaguuau

SEQ ID NO: 6849 - RNA, 62 nt, Human
uuuggcaagcucugugcuaagaacuuuguauacaucaucucauuuaaucuucacaacggccc

SEQ ID NO: 6850 - RNA, 62 nt, Human
uuuggcagggaaaaagggcaauguugauuaaucucaguauuaaaccacauuaaucuguaucc

SEQ ID NO: 6851 - RNA, 63 nt, Human
uuuggccauuauaacuuuuuucugcaaauauucuggugacuuaucuuuggccauuauaaacug

SEQ ID NO: 6852 - RNA, 62 nt, Human
uuuggcuuuuugaaaaacaagcauuucaaaaaugaugaaggaagugaaaguauccuggauca

SEQ ID NO: 6853 - RNA, 64 nt, Human
uuugggaaacccuuccagggcucugguuggaaacuuggccaguaaggacagggccuugggccuc

SEQ ID NO: 6854 - RNA, 61 nt, Human
uuugggagugaugugcuaccuggcucagaagucacugugaacaucauugucccuuucugua

SEQ ID NO: 6855 - RNA, 62 nt, Human
uuugggugagaugcaacuaacagccccuuccuggaugaaggagucaaagaauaaagcuugcc

SEQ ID NO: 6856 - RNA, 64 nt, Human
uuugguaaaaucagugcuuaaauacgcaaugauuuaaacuggaaccugagguauuuuucaugcu

SEQ ID NO: 6857 - RNA, 62 nt, Human
uuugguaauacauuuauuauuauauuuacauguacaguguuacauuauauauguauugugaa

SEQ ID NO: 6858 - RNA, 62 nt, Human
uuugguacuugauucacuuucuuuaaauaaaaacaugaaggaauacccucaauaaaacaggg

SEQ ID NO: 6859 - RNA, 62 nt, Human
uuugguuuugguguauauguucucaacagaaaaccaguguuaaugaauaucaugccucagca

SEQ ID NO: 6860 - RNA, 62 nt, Human
uuuguaaauuaaaaucuuacaaacuaaaucagugugcugcuagaggguucuuuuucacuuga

SEQ ID NO: 6861 - RNA, 63 nt, Human
uuuguacauuuuuguauauacugggacagcgugaaacacuggaauccuucauggacgagggca

SEQ ID NO: 6862 - RNA, 64 nt, Human
uuuguauaacucuaaacgcccaugauaguagcuucaaacuggaaauagcgaaauaaaauaacuc

SEQ ID NO: 6863 - RNA, 64 nt, Human
uuuguauaauuuuuaugcucuuugauuaucuaauaaggccaguauuucaaaagcuguucugaau

SEQ ID NO: 6864 - RNA, 62 nt, Human
uuuguauacaucagauguauauuuuugguuuggcauaagcuacgauuguaauuuuucuuggc

SEQ ID NO: 6865 - RNA, 62 nt, Human
uuugucacuugaaaggaaugaaacugaaugcaaaauaagcuaauuccauauuugcugugcau

SEQ ID NO: 6866 - RNA, 62 nt, Human
uuugucagguuuucccucuuugaacuguuuuuaauguuuacaaaccucacuuuagcucuaac

SEQ ID NO: 6867 - RNA, 62 nt, Human
uuuguccuauggaaaauacuguaauucaggauuauguuuacaauugauccagguguuuguuu

SEQ ID NO: 6868 - RNA, 62 nt, Human
uuugucuuacuaugauaaauaacauauuauuuccuguuuacagcaaccugcacugaaauuaa

SEQ ID NO: 6869 - RNA, 64 nt, Human
uuugugcuuuggguugaaaagaaguuuuuaguccuaggccaguagauggcagcagcuuuucauu

SEQ ID NO: 6870 - RNA, 63 nt, Human
uuugugguacaugaaugaaugcauuuaucuuuuuagugacuuacuaguuacgaacuugaauua

SEQ ID NO: 6871 - RNA, 63 nt, Human
uuugugugcucacaguauauauuauaguaauuagggugacuuagagcaaauacucuucagauc

SEQ ID NO: 6872 - RNA, 62 nt, Human
uuuguuaccuaaguucugguaucuaaggggucucucaucucacagcuugccuccuuuguuuc

SEQ ID NO: 6873 - RNA, 61 nt, Human
uuuguuacuccauguucagcuaauuuagguuugugagauuaacuuuaggauuuuuuguugu

SEQ ID NO: 6874 - RNA, 62 nt, Human
uuuguuaucuucacuuuacugcauaggaaacaaucuaccucaucauuuaaaaugacaugggu

SEQ ID NO: 6875 - RNA, 64 nt, Human
uuuguuggagccacucuguuccuggcucagccucaaaugcaguauuuuuguuguguucuguugu

SEQ ID NO: 6876 - RNA, 64 nt, Human
uuuguuggggggaaugucuguagaacugcaacaucaaugcaguaaguguaguaaaagcuuuagu

SEQ ID NO: 6877 - RNA, 62 nt, Human
uuuguuuaaaaaaaaaaaaaggcaauaucuugacgugcaauaaagugaacugcaauccucgg

SEQ ID NO: 6878 - RNA, 62 nt, Human
uuuguuugugugcaaaccaaacuuucuuuacccagugcaauagauuuguuugacugcuugug

SEQ ID NO: 6879 - RNA, 62 nt, Human
uuuguuuuagaaugucuaggaauuaaacacuuuauguuuacagaauugagcugcagaaagug

SEQ ID NO: 6880 - RNA, 62 nt, Human
uuuguuuucuucucuuuuugucucaagauuguauaugaaggaggcuuuucuucucagcuaac

SEQ ID NO: 6881 - RNA, 62 nt, Human
uuuguuuuuaaaagggggggagcaaaagaaacaccaguguuagcuuaaucuuaaugucuggu

SEQ ID NO: 6882 - RNA, 62 nt, Human
uuuguuuuucagagucaaggaaauuauuuugaacuguuuacaggaacgauaaaccaaaagug

SEQ ID NO: 6883 - RNA, 63 nt, Human
uuuguuuuuuaaacacauuuucacaaguuuuugagacacuggauuucuuuaauuaaaaaaaaa

SEQ ID NO: 6884 - RNA, 62 nt, Human
uuuuaaaauuccuuuaaaaaaugugcuguuaagccaguauuagguaucuuuauuuuguaagu

SEQ ID NO: 6885 - RNA, 62 nt, Human
uuuuaaacccuuucugaacuuucacuuucuaugucuaccucaaagaauuguugugaggcuug

SEQ ID NO: 6886 - RNA, 62 nt, Human
uuuuaaaucaauggagagaaaaaacugaaaaagaugcugcuaaguaguucucuguauuaaag

SEQ ID NO: 6887 - RNA, 62 nt, Human
uuuuaaauugacccuuagcuauagagaauuugcuauaagcuagucuuguuuguaaaaaaaaa

SEQ ID NO: 6888 - RNA, 64 nt, Human
uuuuaagcacugaauucacuacugaucccaucgccuggccaguagaacagucauuacuccauua

SEQ ID NO: 6889 - RNA, 61 nt, Human
uuuuaauacucuggcauucauaaauuuuauugaugagauuauuuauuuuaaagguuugagg

SEQ ID NO: 6890 - RNA, 61 nt, Human
uuuuaauacuuuaaaaaaugucuauaggcaacuugagauuauaguuuuggcuguauaaaua

SEQ ID NO: 6891 - RNA, 62 nt, Human
uuuuaauauuaaauauguucucacuuaauugcuuugcugcuagacuugcaacuaauuuuuuu

SEQ ID NO: 6892 - RNA, 61 nt, Human
uuuuaaucuuaaacacauccagcaaauggugucccugcugaaacuuuuaacuggaaaccuc

SEQ ID NO: 6893 - RNA, 62 nt, Human
uuuuaauggcugccuuuucauuuucaucuuuucuugcugcuacccaucuauguauguaguca

SEQ ID NO: 6894 - RNA, 64 nt, Human
uuuuaauugaauucaaacuaucaagcacuacuuagaaacuggaaaacauauauauguuagcauc

SEQ ID NO: 6895 - RNA, 63 nt, Human
uuuuaauuuccuauggaaaguugcuuaaauuguggacacuggaauuaaucugaaugucacuga

SEQ ID NO: 6896 - RNA, 62 nt, Human
uuuuacaguggacagccucuucucguuucagccucaguauuauguagggaccuuaugcaauu

SEQ ID NO: 6897 - RNA, 62 nt, Human
uuuuacaugaacucaacuuauuccuaacauuugucuaccucaaagaaauuucaagauuauuu

SEQ ID NO: 6898 - RNA, 63 nt, Human
uuuuacaugccacuauauugacuuuaauugauauacaguauuaaguuuuuaggugccauuauu

SEQ ID NO: 6899 - RNA, 61 nt, Human
uuuuacauucaugugguuuucuccacugugaacucugugauucagaaucagaagcaguucu

SEQ ID NO: 6900 - RNA, 61 nt, Human
uuuuacccuguugccauguaugauuauuccuugugagauuacuuaauuacuuggauugaag

SEQ ID NO: 6901 - RNA, 64 nt, Human
uuuuacuugaaauuggaggcauuuuaauaacuggcgaacuggaauguguuucuguauuuguaga

SEQ ID NO: 6902 - RNA, 62 nt, Human
uuuuagaaaacaaagcauuaaaaaaaaagccuaucaguauuaugggcaauauguaaauaaau

SEQ ID NO: 6903 - RNA, 61 nt, Human
uuuuagaauuuugcaaaauucuuuuccccuuauugagauuaauauuuaagauuaaaaaaaa

SEQ ID NO: 6904 - RNA, 62 nt, Human
uuuuagcagauacuuuuuugaugcagaaaaaccugugcaauaaauuaccaguaauaaaguca

SEQ ID NO: 6905 - RNA, 62 nt, Human
uuuuaggcaguguucacaaucauagcaccuaaauaugaaggaucagaauaaguuaugaaaug

SEQ ID NO: 6906 - RNA, 64 nt, Human
uuuuagucacugugaaauauuucacauucagccuccaugcaguagagauuugaguuuaauuuca

SEQ ID NO: 6907 - RNA, 61 nt, Human
uuuuaguccucauuuuuggucuugucucugcggacugugaagaaucacaaugcucuauaug

SEQ ID NO: 6908 - RNA, 62 nt, Human
uuuuaguuuccucaguggaagauaauaaauccgccuaccucauaaagguuuggugagaauua

SEQ ID NO: 6909 - RNA, 62 nt, Human
uuuuauaaugcccugcaacucuaaaccauccuuuuguuuacacauuuuuguaugguauuuua

SEQ ID NO: 6910 - RNA, 64 nt, Human
uuuuauagccaaguacauuuuauuuucuugcugaugaacuggaauuggauaaauauugcaagug

SEQ ID NO: 6911 - RNA, 64 nt, Human
uuuuauaguacaucuuguuugucucccugugaaaacaacuggaaucuuaaaaaaggaguuuuua

SEQ ID NO: 6912 - RNA, 63 nt, Human
uuuuauaguaguuuuuuuguauuuuuuuguaaugacaguauuauguaaaaaauaaaguauuuu

SEQ ID NO: 6913 - RNA, 63 nt, Human
uuuuauaugugagcgagcaagccggcaagcgagcacaguauuauuucuccauccccucccugc

SEQ ID NO: 6914 - RNA, 61 nt, Human
uuuuauauucuauuuaugauauccauaaucaaaugagauuauuuuaccacauaaauguuuu

SEQ ID NO: 6915 - RNA, 64 nt, Human
uuuuauauuuuugguuuuacaagaaaaaacauuaaaaacuggaaaggagauguggagcccccac

SEQ ID NO: 6916 - RNA, 62 nt, Human
uuuuaugucuguuaaauaucaaaacaauuugcuacaguguuaaucugcauggucuuuaagcc

SEQ ID NO: 6917 - RNA, 62 nt, Human
uuuuauguggaugaagagcauuuuuuaugcuuuugugcaauagguuccaauaugcauuuauu

SEQ ID NO: 6918 - RNA, 62 nt, Human
uuuuauguucucaagaaauaaguuguugccuauucaguguuacagauuucuuuguuucuuuu

SEQ ID NO: 6919 - RNA, 62 nt, Human
uuuuauguuuguacacaacaccuaaaaccaguuuugcugcuauaauucuauacuguugauuc

SEQ ID NO: 6920 - RNA, 62 nt, Human
uuuuauugccuggaucugcuuuaaagacaauugguguuuacacccucuugucagcaaaacag

SEQ ID NO: 6921 - RNA, 62 nt, Human
uuuuauuguuuauggaaauucaauuaauuuuuggugcugcuauugcauugugcaaauccacu

SEQ ID NO: 6922 - RNA, 62 nt, Human
uuuuauuuugcuuuuuggcauuucagacuuugaucaguguuaagugcacuuguauugcuuuu

SEQ ID NO: 6923 - RNA, 62 nt, Human
uuuucaaaaccagcuuuuuucuauauauaaauuaugcugcuauuacagauuuaacauuuucu

SEQ ID NO: 6924 - RNA, 61 nt, Human
uuuucaaaacuauuuucuuaaacauuuauuucaugagauuauguucaacccuguaccuggu

SEQ ID NO: 6925 - RNA, 61 nt, Human
uuuucaaacuaauugcuuaaaucuagaaccaguugagauuaguacuguacaaugguaugcu

SEQ ID NO: 6926 - RNA, 62 nt, Human
uuuucacagcugcuuguuuauugcuuguuuuauauguuuacauaucucaaaaucuguuaaaa

SEQ ID NO: 6927 - RNA, 62 nt, Human
uuuucaccuagcuuuuaaaguuauucuuuguccuucaucucagaagggaucucuuuagcuua

SEQ ID NO: 6928 - RNA, 63 nt, Human
uuuucauuguaggaucagcagcagguuaaagacugaacgguuagugaagacaaaugucuuaag

SEQ ID NO: 6929 - RNA, 64 nt, Human
uuuucauuuguugauuuaggaaaaagcauaaauagaaugcaguauaacaccacuuccaaaggua

SEQ ID NO: 6930 - RNA, 63 nt, Human
uuuuccacccugaaaggaaauguuuuucuuugcagcaguauuagauaaugaaaaaugcuaauu

SEQ ID NO: 6931 - RNA, 62 nt, Human
uuuucccuccucuauucaguguuucaaacuuuggucaucucaaauuauugucacuuuuaaaa

SEQ ID NO: 6932 - RNA, 62 nt, Human
uuuucccuuucuuuaaaagaaacuuaacuguucuaugaaggagauugagggagaagagacaa

SEQ ID NO: 6933 - RNA, 62 nt, Human
uuuuccucaaagcucaauuagaauagcaaaauuuauaagcuaguaaacuuauacuauagcaa

SEQ ID NO: 6934 - RNA, 62 nt, Human
uuuuccugggauccuccuucguggucuucuaagucaguguuaguuuugaaauuuuuggcccu

SEQ ID NO: 6935 - RNA, 63 nt, Human
uuuuccuguaguuuagcuucguugaauuuuuuuugacacuggaaauguucaacuguaguuuua

SEQ ID NO: 6936 - RNA, 63 nt, Human
uuuuccuucuuucuuuucaccuuuagguuaauauccaguauuauguguuaucccuuuggauaa

SEQ ID NO: 6937 - RNA, 62 nt, Human
uuuucuaaauuacuaugucagguuguaaaagucagugcaauaacaaaccuuccuuuuuaaga

SEQ ID NO: 6938 - RNA, 63 nt, Human
uuuucucuaccugcccuugggcucacuaauaucaccaguauuauuaccaagaaaauauugagu

SEQ ID NO: 6939 - RNA, 62 nt, Human
uuuucucucuaggaaaugggggugauaauugugccuaccucagauagacagugccagaauua

SEQ ID NO: 6940 - RNA, 61 nt, Human
uuuucugaaugucaaggcagugaggugccucucacugugaauuuguggugggcgggggcug

SEQ ID NO: 6941 - RNA, 64 nt, Human
uuuucugacauaagaauauauuaucaauacaguuuuaugcaguaagcucuccuuaccauaaaug

SEQ ID NO: 6942 - RNA, 62 nt, Human
uuuucugagguaacuggguaauagaauaucaaauugcugcuaucucggaccuauuguuaaag

SEQ ID NO: 6943 - RNA, 64 nt, Human
uuuucugauccagacccucggcaccugcuacuuaccaacuggaaaauuuuaugcaucccaugaa

SEQ ID NO: 6944 - RNA, 62 nt, Human
uuuucuguaaguaaguuugguuucaucaugagggaugaaggaaaagauuugauacugaaaac

SEQ ID NO: 6945 - RNA, 62 nt, Human
uuuucuguguuuagcuauuuaauacuaauuuuccauaagcuauuuugguuuagugcaaagua

SEQ ID NO: 6946 - RNA, 61 nt, Human
uuuucuuccucaccuguuccauuuauguaaaguugagauuagagggaaagcauuuucuaua

SEQ ID NO: 6947 - RNA, 62 nt, Human
uuuucuugauccaaaguuugugaauuuggcuuugcuaccucaauugcagguguuuguuugcc

SEQ ID NO: 6948 - RNA, 61 nt, Human
uuuucuuguuucuuauuuucuuaacccuuaacuccugcugaggucauaacaaccucagucu

SEQ ID NO: 6949 - RNA, 64 nt, Human
uuuucuuucaauccucauuaucuuuagcccucagcuggccaguacuuauugcuaaagaaaggga

SEQ ID NO: 6950 - RNA, 63 nt, Human
uuuucuuugcuuucagcccauguaaauaaauaauacaguauuaacauuuucgugcugcuuccc

SEQ ID NO: 6951 - RNA, 62 nt, Human
uuuucuuuuguuacguaguggaaacauuuugcauuguuuacauaguucucauggaacaugga

SEQ ID NO: 6952 - RNA, 62 nt, Human
uuuugaacuguuuauuauaugguggaugaugauuucaucucacgugcuggacgcuguucugu

SEQ ID NO: 6953 - RNA, 61 nt, Human
uuuugagaccauauguaugcuauuaaaauauauugagauuaauacaugaaaaugcuuaaaa

SEQ ID NO: 6954 - RNA, 64 nt, Human
uuuugagacggagucuugcucuguugccacgcuggaaugcaguaacgugaucuuggcucacugc

SEQ ID NO: 6955 - RNA, 61 nt, Human
uuuugagagagacugagagaaccauaauccuugccugcugaacccagccugggccuggaug

SEQ ID NO: 6956 - RNA, 63 nt, Human
uuuugagauuuuauuuugugauguauugucuucugcaguauuaaagggaaagagauauuaaug

SEQ ID NO: 6957 - RNA, 64 nt, Human
uuuugauuuauucuuuuuaagaaggaguagaguugcaacuggaaaacacagacaccagaaauga

SEQ ID NO: 6958 - RNA, 62 nt, Human
uuuugcaguacucuguagacauuagucaguaauacaguguuauuucuaggcucugaaauagc

SEQ ID NO: 6959 - RNA, 64 nt, Human
uuuugccacccccugugagcagggauuagguguucaggccaguaucuugggcaugggggagccu

SEQ ID NO: 6960 - RNA, 62 nt, Human
uuuugcggagacgguauugcuauguugccaagguuguuuacaugccaguacaauuuauaaua

SEQ ID NO: 6961 - RNA, 62 nt, Human
uuuugcuaggucacagaggaucugcuuggucuugauaagcuauguuguugcacuuuaaacau

SEQ ID NO: 6962 - RNA, 62 nt, Human
uuuugcuuucccagcgggaggggaggaagaagaguguuuacaaaguccuguagcccccucac

SEQ ID NO: 6963 - RNA, 62 nt, Human
uuuuggaaacaauugacaaaauagggcaggcagcucaucucauguccugaaguuggaauuua

SEQ ID NO: 6964 - RNA, 62 nt, Human
uuuuggcauaauagucaauuucuacuucuggaagucaucucauuccacuguugguauuauau

SEQ ID NO: 6965 - RNA, 63 nt, Human
uuuuggcucugguguuuucgccagacaauaaacuuacacuggaagcuuugauucacccuccac

SEQ ID NO: 6966 - RNA, 62 nt, Human
uuuuggggggccaguaguucagugagaauguuuauguuuacaacuagccuucccaguaaaaa

SEQ ID NO: 6967 - RNA, 62 nt, Human
uuuugguaugaaauugucuuucuccauugcagaaauaagcuagggaaacacuaacccaaaaa

SEQ ID NO: 6968 - RNA, 63 nt, Human
uuuuggugugggaguugucaugaggcuguguugaagugacuuaucuaugugggauauugagua

SEQ ID NO: 6969 - RNA, 61 nt, Human
uuuugguguuucucaagagucugucuuccuauaacugugaaaggaggauuucuggaauuca

SEQ ID NO: 6970 - RNA, 63 nt, Human
uuuugguuuuugcagcaguaaaaacucuuuccacugugacuuauuuucucucucaggcagcca

SEQ ID NO: 6971 - RNA, 64 nt, Human
uuuuguaaauugaauuuuuuuuuuaaaucuauuaggaacuggaaaacagcaaguaugguugauu

SEQ ID NO: 6972 - RNA, 64 nt, Human
uuuuguacuuuugcagaagaaacuucagcaagcuagaacuggaagguacuuuaauuuuucauau

SEQ ID NO: 6973 - RNA, 62 nt, Human
uuuuguagaaucucuucaugcuugacauaccuaccaguauuauucccgacgacacauauaca

SEQ ID NO: 6974 - RNA, 62 nt, Human
uuuuguaguauuuaauaaucuggauggagccugucaguauuacaguuaguuuucuagugacu

SEQ ID NO: 6975 - RNA, 62 nt, Human
uuuuguauauuuauucuauuuuguauauuguuaagugcaauaaaguuuuugccuugcuuuau

SEQ ID NO: 6976 - RNA, 62 nt, Human
uuuuguauuuucuauacugguguuagaaaacauauguuuacauuugauuaacuguguugccu

SEQ ID NO: 6977 - RNA, 63 nt, Human
uuuugugaaauucccaguuaaauauauacaacuaugugacuuagugcacaacacauuugugaa

SEQ ID NO: 6978 - RNA, 62 nt, Human
uuuugugaugguguucuggguccauacaccagcaaugaaggagauagauuuguguacuugug

SEQ ID NO: 6979 - RNA, 60 nt, Human
uuuuguggacacuuguugaggagagcaccggaucaucucagacauaucggugcccugcaa

SEQ ID NO: 6980 - RNA, 62 nt, Human
uuuuguucccauaccaguuugguuucgcuaccuuauaagcuauggggaguuugguaacguaa

SEQ ID NO: 6981 - RNA, 62 nt, Human
uuuuguucuguuuuguauuucaauuaggaacuugcaguauuauuuugaaaaccauucuaaaa

SEQ ID NO: 6982 - RNA, 62 nt, Human
uuuuguugagaggaaaagugaauugguuaaaagagugcaauaaggauccaaauacagugacu

SEQ ID NO: 6983 - RNA, 64 nt, Human
uuuuguugcuaaaaaguuuuuaggccagugcaaauuaugcaguagaacuuguguugcaaaagga

SEQ ID NO: 6984 - RNA, 62 nt, Human
uuuuguuuuauaaaucauaguaucugucaucuugcaguauuaccaaugcuguuguaaauuga

SEQ ID NO: 6985 - RNA, 62 nt, Human
uuuuguuuuuaagacucauggacauuucauaccugugcaauacugaagaccucauucuguca

SEQ ID NO: 6986 - RNA, 63 nt, Human
uuuuuaaaauuccuuuaaaaaaugugcuguuaagccaguauuagguaucuuuauuuuguaagu

SEQ ID NO: 6987 - RNA, 61 nt, Human
uuuuuaaacucugccaugaaauuuggagacaugacugugaaauuccuaacuuacuaucuua

SEQ ID NO: 6988 - RNA, 62 nt, Human
uuuuuaaagcuauuuuucaaggaaccuuuuuuugcaguauuauugaauuuauuuucuaaauc

SEQ ID NO: 6989 - RNA, 64 nt, Human
uuuuuaaauuagcaacuucaaguauaacaacuuugaaacuggaauaaguguuuauuuucuauua

SEQ ID NO: 6990 - RNA, 62 nt, Human
uuuuuaauuugagaggguuuuuauuucauggaggcaguguuaacuaaaauuaagcuuagauu

SEQ ID NO: 6991 - RNA, 62 nt, Human
uuuuuaauuugaggggaaaagaaauguuuuacagaugaaggaauguuuuauaguaauuuaau

SEQ ID NO: 6992 - RNA, 62 nt, Human
uuuuuaccuugucauuuuggucuaagguugccauugcugcuaaagguuaccgauuucaaagu

SEQ ID NO: 6993 - RNA, 62 nt, Human
uuuuuacuuucaaaauugcauuauagugaauuacuguuuacaaaauacacauacugugaaca

SEQ ID NO: 6994 - RNA, 64 nt, Human
uuuuuagaaaugugaagaggucugauuggcugcuuaaacuggaaaggaucugugauuggcuggu

SEQ ID NO: 6995 - RNA, 63 nt, Human
uuuuuauauuaugccgcuuucaauccaacguucucacacuggaagaagagaguuucuaaucag

SEQ ID NO: 6996 - RNA, 62 nt, Human
uuuuuaucgucacugcuuaacuucacauauugauuuccguuaaaauaccagccaguaaaugg

SEQ ID NO: 6997 - RNA, 62 nt, Human
uuuuuaugaagaauuuuugucuaggagaauauaacaguguuacccaagguugugucuuuaag

SEQ ID NO: 6998 - RNA, 62 nt, Human
uuuuuaugcagcugcaaaagcaguugaaauaguuugcugcuaagucaggagaaaauauccag

SEQ ID NO: 6999 - RNA, 63 nt, Human
uuuuuauuuagcauggggauugcagagugaccagcacacuggacuccgaggugguucagacaa

SEQ ID NO: 7000 - RNA, 62 nt, Human
uuuuucaauugacaagacuuuaagucagggauaacaguauuaauguucucuguucuguuucc

SEQ ID NO: 7001 - RNA, 62 nt, Human
uuuuucauucacuuuaauagaagggcaaauauuuauaagcuauuucuguaccaaaguguuug

SEQ ID NO: 7002 - RNA, 62 nt, Human
uuuuucauuuauaccaguuuucuuuaugaugauacaguguuaaaagaaaauaaauuacaauu

SEQ ID NO: 7003 - RNA, 62 nt, Human
uuuuuccuaguugaugccuuccuuuauuacaaaucaguauuaaaacuuccagauuauauucu

SEQ ID NO: 7004 - RNA, 63 nt, Human
uuuuucgaccugcccaggucucuugcuagacuucugugacuuacaguucucuucuaaaaagca

SEQ ID NO: 7005 - RNA, 64 nt, Human
uuuuucuaacuaucucauuacaauuggugcacaaugaacuggaaaauauaaaaagugacacuuu

SEQ ID NO: 7006 - RNA, 62 nt, Human
uuuuucugaguuucucguaaugcucauuuuuacaugcugcuacuagcuuuuuuuuuuaaaaa

SEQ ID NO: 7007 - RNA, 62 nt, Human
uuuuucuuaucaaguuucucaaccuuuauuuuuaaugaaggaggugcugaguuuuguaucuu

SEQ ID NO: 7008 - RNA, 62 nt, Human
uuuuucuuuuaauaggcugggccacauguuggaaauaagcuaguaauguuguuuucugucaa

SEQ ID NO: 7009 - RNA, 61 nt, Human
uuuuugagaauacuggaccaucauuaaauguguacugugaagagauuaauauguaugaagg

SEQ ID NO: 7010 - RNA, 64 nt, Human
uuuuugcaauccuuuccucagaccuggcuccaggcuaacuggaaggcagcacucccuuuuuuau

SEQ ID NO: 7011 - RNA, 63 nt, Human
uuuuuggauuuauuaaauauuuucuguggugugaagugacuuauuaaauccacagacauugag

SEQ ID NO: 7012 - RNA, 62 nt, Human
uuuuuggcuuucuuuuuucccacagcaacugccaaugaaggaugaauccccuuuuuaaaaag

SEQ ID NO: 7013 - RNA, 63 nt, Human
uuuuugguuucuuuaucaugcuacagagagugaauacacuggaauucagacaccgacucugag

SEQ ID NO: 7014 - RNA, 62 nt, Human
uuuuugguuuucucuuuaaaaagaggauuuagaugugcaauaaugcaaauaucaguagcuua

SEQ ID NO: 7015 - RNA, 62 nt, Human
uuuuugguuuuguuuuuauuuuuauuuguuguucuguuuacaaaucaggagagccccuguuu

SEQ ID NO: 7016 - RNA, 62 nt, Human
uuuuuguaaaagaaucaagauuuguauaaaauguuguuuacagaucuuuuaaugaauaaaua

SEQ ID NO: 7017 - RNA, 64 nt, Human
uuuuuguaaagagcuugcacguguggaaaucaaguaggccaguaguggguuagggguacugagc

SEQ ID NO: 7018 - RNA, 63 nt, Human
uuuuuguagaaucucuucaugcuugacauaccuaccaguauuauucccgacgacacauauaca

SEQ ID NO: 7019 - RNA, 62 nt, Human
uuuuugucaguuuguuugccuuacucauuucuaagugcaauaagggagugucucacaggauu

SEQ ID NO: 7020 - RNA, 64 nt, Human
uuuuuguuagagaugagaaaaggauugagaaggauaaacuggaauccugguaagaagccuuuau

SEQ ID NO: 7021 - RNA, 63 nt, Human
uuuuuguucuguuuuguauuucaauuaggaacuugcaguauuauuuugaaaaccauucuaaaa

SEQ ID NO: 7022 - RNA, 61 nt, Human
uuuuuguugcacaaguauuuggacagaagucgaacugugaaugagauacugaaaugcacua

SEQ ID NO: 7023 - RNA, 63 nt, Human
uuuuuguuuuauaaaucauaguaucugucaucuugcaguauuaccaaugcuguuguaaauuga

SEQ ID NO: 7024 - RNA, 64 nt, Human
uuuuuuaaaacuaauaaauagugacugaaccaauuuaugcaguaaauagacuaaaguucacagg

SEQ ID NO: 7025 - RNA, 61 nt, Human
uuuuuuaaaagguagagucuuacaaucaaaucuccugcugauuucacuuugggauaugguc

SEQ ID NO: 7026 - RNA, 63 nt, Human
uuuuuuaaagcuauuuuucaaggaaccuuuuuuugcaguauuauugaauuuauuuucuaaauc

SEQ ID NO: 7027 - RNA, 63 nt, Human
uuuuuuagaaaguauauuuuuguaugcuuuguuuugugacuuaaaaguguuaccuuuguaguc

SEQ ID NO: 7028 - RNA, 62 nt, Human
uuuuuuaucuuuaauguugucaccuuggucugauucaucucacucugauuacuaauauagcu

SEQ ID NO: 7029 - RNA, 62 nt, Human
uuuuuuauuauugcauuuuauuuugacccuggacugcugcuaugaacaauagaauaugcauu

SEQ ID NO: 7030 - RNA, 62 nt, Human
uuuuuuauuuuccaauacugcauccauggccuggcaguguuaccucaugaugucauaauuug

SEQ ID NO: 7031 - RNA, 62 nt, Human
uuuuuucaaaaaugaauuuuuauuuaaugugguucaguauuauaauaacaaagcauuuuugu

SEQ ID NO: 7032 - RNA, 64 nt, Human
uuuuuucaaauuguguuuagaaauacuguaauaaauaugcaguagugauauaaagaauuauauc

SEQ ID NO: 7033 - RNA, 63 nt, Human
uuuuuucaauugacaagacuuuaagucagggauaacaguauuaauguucucuguucuguuucc

SEQ ID NO: 7034 - RNA, 62 nt, Human
uuuuuuccccucauaaccuuguuuuugguagaaaauaagcuagagaaauuaagccaucgugu

SEQ ID NO: 7035 - RNA, 61 nt, Human
uuuuuuccccuuggaagacacuauugaucucaaccugcugacuuuuccuaaugcuuaccug

SEQ ID NO: 7036 - RNA, 63 nt, Human
uuuuuuccuaguugaugccuuccuuuauuacaaaucaguauuaaaacuuccagauuauauucu

SEQ ID NO: 7037 - RNA, 62 nt, Human
uuuuuucuuuguuuuaaaggacuaauguuuauuacaguguuaaauaaaaguguaagauacua

SEQ ID NO: 7038 - RNA, 62 nt, Human
uuuuuugccaaccauugccaaugucaaucaaucacaguauuagccucuguuaaucuauuuac

SEQ ID NO: 7039 - RNA, 61 nt, Human
uuuuuuguaaugccuuuguacagcucauacuuuccugcugacauaucugaucaucucuuuc

SEQ ID NO: 7040 - RNA, 62 nt, Human
uuuuuuguucgguacaauaaaguuuacuaaaaaacaguauuaggguuuauuuggaguuaacu

SEQ ID NO: 7041 - RNA, 62 nt, Human
uuuuuuuaaaaagugcaauuugcguugcagcaaucaguguuaaaucauuugcauaagauuua

SEQ ID NO: 7042 - RNA, 62 nt, Human
uuuuuuuaaucuacugcauuuagggaguauucuaauaagcuaguugaauacuugaaccauaa

SEQ ID NO: 7043 - RNA, 62 nt, Human
uuuuuuuauuuuauugcuuauaauuuauuaagaauguuuacaccuguauaaggauuucauau

SEQ ID NO: 7044 - RNA, 62 nt, Human
uuuuuuuccuuccaauuuugugauaaauucaugauguuuacagcacagauaaaacuuugugc

SEQ ID NO: 7045 - RNA, 63 nt, Human
uuuuuuugccaaccauugccaaugucaaucaaucacaguauuagccucuguuaaucuauuuac

SEQ ID NO: 7046 - RNA, 63 nt, Human
uuuuuuuguucgguacaauaaaguuuacuaaaaaacaguauuaggguuuauuuggaguuaacu

SEQ ID NO: 7047 - RNA, 62 nt, Human
uuuuuuuuaauguaucuuaacuguugccugucaguguuuacaaacuagugcguugacggcac

SEQ ID NO: 7048 - RNA, 62 nt, Human
uuuuuuuucucacaaaguaaauggugggcauccauguuuacauugcaccuucccgugcugua

SEQ ID NO: 7049 - RNA, 62 nt, Human
uuuuuuuuuaagauauaugacuaaaauggacaauuguuuacaaggcuuaacuaauuuauuug

SEQ ID NO: 7050 - RNA, 63 nt, Human
uuuuuuuuuagugacugggucucacucuguugcccacacuggaaugcaguggcaugaucacag

SEQ ID NO: 7051 - RNA, 64 nt, Human
uuuuuuuuucuggguauguaaucuauuuuuuuuuuaaacuggaaagcauuuuugucagugugaa

SEQ ID NO: 7052 - RNA, 62 nt, Human
uuuuuuuuuuugagaguuauucuggaaauguguuauaagcuaggagaaucccuuuggacagu

SEQ ID NO: 7053 - RNA, 62 nt, Human
uuuuuuuuuuuuuaaaaaaaauacuaugcccauuuguuuacaaaucgucugugggugcuuuc

SEQ ID NO: 7054 - RNA, 64 nt, Human
uuuuuuuuuuuuuuaaacgagaacaagaauaugaagaacuggaaaucauuaagaaaggguuucc

SEQ ID NO: 7055 - RNA, 64 nt, Human
uuuuuuuuuuuuuuuuggcuugacucaggauuuaaaaacuggaacggugaaggugacagcaguc

SEQ ID NO: 7056 - RNA, 62 nt, Human
uuuuuuuuuuuuuuuuuuuuuuuuaaggacugggucaucucauaagagcuaagcaugacaga

SEQ ID NO: 7057 - RNA, 62 nt, Human
gucuucccacuucacuaaccaaauuccuacuuuccaguguuacuucccaauuuaugcaggaa

SEQ ID NO: 7058 - RNA, 62 nt, Human
gucuugaggcuguugagaaacuuaggacagaagccuaccucaucccaggccugccccuccgu

SEQ ID NO: 7059 - RNA, 62 nt, Human
gucuugaucaaaucaaacuaagaagaccuuagaaauaagcuaccauuuugccacagagcagc

SEQ ID NO: 7060 - RNA, 62 nt, Human
gucuugguagaugucccuagacgggcugagccaugugcaauaagaacauagauccuaaagga

SEQ ID NO: 7061 - RNA, 62 nt, Human
gucuugugaagaaaaguugaauacuguuuuguuuucaucucaagggguucccugggucuuga

SEQ ID NO: 7062 - RNA, 64 nt, Human
gucuuugcaguauuacacaauaccgcaugagcuaauaugcaguauuuagguaaugcauugaaug

SEQ ID NO: 7063 - RNA, 64 nt, Human
gucuuuugcuuguacagaaucuguagugauuuugguggccaguaaaugccagccauuucucaaa

SEQ ID NO: 7064 - RNA, 62 nt, Human
gugaaaaaagaaaucuguuuaaaauacugaauuuucaucucacucccauugcaaaucaagga

SEQ ID NO: 7065 - RNA, 62 nt, Human
gugaaaaugggaugauauugacaaauggagacuccuaccucaauaguuaauggaauaauaag

SEQ ID NO: 7066 - RNA, 62 nt, Human
gugaaauaggcauaacaguaauacauaacccuaccuaccucacagggcuguugugaggauca

SEQ ID NO: 7067 - RNA, 62 nt, Human
gugaagaacacuacugcuaaauccucauguuacucaguguuagagaaauccuuccuaaaccc

SEQ ID NO: 7068 - RNA, 62 nt, Human
gugaagauuucuucuuucccuguaccagcuguuacaguguuacguuguguuuaaaaugugua

SEQ ID NO: 7069 - RNA, 61 nt, Human
gugaagcaaauccagacuccuugccguucagccacugugaaaccagaaucugcuucacaga

SEQ ID NO: 7070 - RNA, 62 nt, Human
gugaagggauuaauauugaccagagccaaugaggucaucucauccuugaggggagcaggugu

SEQ ID NO: 7071 - RNA, 62 nt, Human
gugaaguacucaucuugcaggaagcaaaccuccuuguuuacaucuucaggccaagaugacug

SEQ ID NO: 7072 - RNA, 62 nt, Human
gugaaguuuuccuugcuauuucaauaacagauggugcugcuaauucccaacauuucuuaaau

SEQ ID NO: 7073 - RNA, 62 nt, Human
gugaauaugugcuuuuacuguacauagugcuauugugcaauaggucuuaugcuguuuucacu

SEQ ID NO: 7074 - RNA, 64 nt, Human
gugaaucauuuuacuaauuguacuuuuaugcuauaaaugcaguacauuugaaaauuuuuagauu

SEQ ID NO: 7075 - RNA, 62 nt, Human
gugaaugugggugucggcugcggcauuaaauucaucaucucaacccagagugucuggucucc

SEQ ID NO: 7076 - RNA, 62 nt, Human
gugacaagcucagagagcaugaacugaugcuggcaugaaggauuccaggaagaucauggaga

SEQ ID NO: 7077 - RNA, 62 nt, Human
gugacagaugguccugcagugugaaacugaaggacaguguuaaagcugggcucuaguauauu

SEQ ID NO: 7078 - RNA, 62 nt, Human
gugacagggcuggggccacagucuacucugucucugcugcuagagaagccaccuguggagga

SEQ ID NO: 7079 - RNA, 62 nt, Human
gugaccuuuuccuaugucuaggcuccuccacaggugcugcuauuuugugagcuccggcuccu

SEQ ID NO: 7080 - RNA, 64 nt, Human
gugacucaacugcccagacaccucauuguacuugaaaacuggaacagcuugggaaugccauggg

SEQ ID NO: 7081 - RNA, 63 nt, Human
gugacuggagcauucaggaagaggcuuuccagggaacacuggacauugcuuagugaccuuuug

SEQ ID NO: 7082 - RNA, 62 nt, Human
gugagagcguuggacccaggcuuggcugccugacauaagcuaaaucucccagacccaccacu

SEQ ID NO: 7083 - RNA, 61 nt, Human
gugagcccacugccacugccucagaagggagccacugugaaccucucgaguggcuccaaag

SEQ ID NO: 7084 - RNA, 62 nt, Human
gugagccucaugguuuucagagaagucauuguucuguuuacauuuucauaaaaccuguuuaa

SEQ ID NO: 7085 - RNA, 64 nt, Human
gugagcgggauucagcaaugguggaauggaagacagaacuggaagagaaagaaggaaaagauga

SEQ ID NO: 7086 - RNA, 62 nt, Human
gugaggacucagaaaaucaaagggcuaguagaaacaguguuauguugggaagcaggguaccc

SEQ ID NO: 7087 - RNA, 61 nt, Human
gugagguuugaaccacuguuucacugcauagucccugcugauggacacuugaguguucaga

SEQ ID NO: 7088 - RNA, 64 nt, Human
gugaguacugacauuuagagcuguuuaaaggccgagaacuggaaacagccuuuccuccauuuuc

SEQ ID NO: 7089 - RNA, 64 nt, Human
gugaguacugacauuuagaguuguuuaaaggccaagaacuggaaacagccuuuucccuauuuuc

SEQ ID NO: 7090 - RNA, 62 nt, Human
gugaucuaaauguacaaaauguaaaauguauaagucaucucacuuuuugucaagacauuaaa

SEQ ID NO: 7091 - RNA, 62 nt, Human
gugaucuuuccaccuugaacacuuccaagugacucuaccucaccaagcaguccauucaguug

SEQ ID NO: 7092 - RNA, 62 nt, Human
gugaugggguuuugcucuuguugcccaggcuggagugcaauagcgcaaucucagcucacugc

SEQ ID NO: 7093 - RNA, 61 nt, Human
gugauuaggucaugaggguggaauauuugagaaugagauuagugcccuugugaauuaggcc

SEQ ID NO: 7094 - RNA, 64 nt, Human
gugauuugcccucuuauguauuuuggucauauugccaacuggaaagucaaaauuuucuaacaac

SEQ ID NO: 7095 - RNA, 61 nt, Human
gugauuuuaaugaaacauggauaguuguggccaccugcugacuauuugugguuuaaaauaa

SEQ ID NO: 7096 - RNA, 62 nt, Human
gugauuuuacaauaacauuaucaucugcaguuacuguuuacaagacugcuuuuaccuuaaac

SEQ ID NO: 7097 - RNA, 62 nt, Human
gugcaacaugggagagaaguucuuauuguuggccaugaaggaaaaucacccagaaugcuucu

SEQ ID NO: 7098 - RNA, 62 nt, Human
gugcaauuugguucuugaaaauuaaauuuaaacuuguuuacaaagguuuaguuuuguaauaa

SEQ ID NO: 7099 - RNA, 61 nt, Human
gugcacacguggcuugccugaaugaacaugcccacugugaaagauuccauuucucaacaca

SEQ ID NO: 7100 - RNA, 63 nt, Human
gugcacaggcaagacuugcuucagccccagguguggugacuuagaccuaggaaaccaauuaug

SEQ ID NO: 7101 - RNA, 61 nt, Human
gugcacccccaacuucauagggguagaggcuccugagauuaggagaacccuuuuuaggcuu

SEQ ID NO: 7102 - RNA, 63 nt, Human
gugcacccccaagauggaacaucccugcugcauucacacuggaacaagccccuccagaugagu

SEQ ID NO: 7103 - RNA, 61 nt, Human
gugcagcgggugcgggugccgcuuaaacauuucccugcugaguggcucguguuucacagug

SEQ ID NO: 7104 - RNA, 62 nt, Human
gugcaggacggaauauagaggagcacuauuauggaugaaggacgugucucaggagcuugauc

SEQ ID NO: 7105 - RNA, 62 nt, Human
gugcauccuuugauuacucucaugcugcauuuacuguuuacauuuguuuuauuguacauagg

SEQ ID NO: 7106 - RNA, 64 nt, Human
gugcaugucaagugaggguuucuuucugcgauguucaacuggaacucucccaucaguaguuaca

SEQ ID NO: 7107 - RNA, 61 nt, Human
gugcauuaggcuguaguucuaauauugaguucaacugugaaauccaucagaugugccaaau

SEQ ID NO: 7108 - RNA, 62 nt, Human
gugccacugccugacugucaucuucuccagaucuuguuuacagaguaauaaugacguuaaac

SEQ ID NO: 7109 - RNA, 62 nt, Human
gugccaugaaaaugugguugaauuauucauuaugcaguguuauugguaaguguauuuucacu

SEQ ID NO: 7110 - RNA, 62 nt, Human
gugccaugaagcaguuacagaaacagaauugaugugcugcuaaaaaaaaaaaaaaaaauggg

SEQ ID NO: 7111 - RNA, 64 nt, Human
gugcccaacaacuuuacuugccuacaacgguucacaaacuggaacaggccauauucaaagccag

SEQ ID NO: 7112 - RNA, 62 nt, Human
gugcccagcagcucuuggucaaagcacuguugcuauaagcuaucucugggaugccucuaggc

SEQ ID NO: 7113 - RNA, 64 nt, Human
gugcccaggacagccgugguggggaccggguaugccaacuggaaugauucuagaaccaaaauaa

SEQ ID NO: 7114 - RNA, 62 nt, Human
gugccccugccgagguggccugcagugcuguacauguuuacagaagcugcugggcuuggcuc

SEQ ID NO: 7115 - RNA, 62 nt, Human
gugcccuugugaauuaggccugagagagauccccucaucucaccauguaaggacacagcaga

SEQ ID NO: 7116 - RNA, 61 nt, Human
gugccucagaucauccaccugugugaguccaucacugugaaauugacuguguccaugugau

SEQ ID NO: 7117 - RNA, 62 nt, Human
gugccuccucucaccuggccagacucugacccaccuaccucagcuggggugaggggcacccc

SEQ ID NO: 7118 - RNA, 64 nt, Human
gugccuuaaaaugagucauacaucuuuuaaauuggaaugcaguaauagauaugugauuuuacau

SEQ ID NO: 7119 - RNA, 64 nt, Human
gugccuuacccucuguaagauacugauucuuccuggggccaguauuaccuuguaugcaaauauu

SEQ ID NO: 7120 - RNA, 63 nt, Human
gugcuacccucccaauucccccauuauggaguaaccaguauuauucagugagcuaugggguag

SEQ ID NO: 7121 - RNA, 63 nt, Human
gugcuagaaaucuugugccccauaugugcuucuuucaguauuauccuagauccucaggaguag

SEQ ID NO: 7122 - RNA, 62 nt, Human
gugcuauuguguguucucaguuuaagauagcagaucaucucagcaguaagcacaccaacaga

SEQ ID NO: 7123 - RNA, 62 nt, Human
gugcugagaauccuacccuuccuugcugucacuacaguauuaauauuuuacuguauuuucuu

SEQ ID NO: 7124 - RNA, 62 nt, Human
gugcugaguuguaugucuuugcauagcuccacucugcugcuaaauaugcauguucugacuga

SEQ ID NO: 7125 - RNA, 62 nt, Human
gugcuguaaaaacugugggaugcuccucccuucucuaccucauggggguauuguauaagucc

SEQ ID NO: 7126 - RNA, 63 nt, Human
gugcugucuucugcuggccucauccugcagcagggacacuggagagcaauggucccugccagc

SEQ ID NO: 7127 - RNA, 61 nt, Human
gugcuuaauagggaacauacauacagcuauguaacugugaauaauuguauauaucucuagu

SEQ ID NO: 7128 - RNA, 62 nt, Human
gugcuuaguugaaacaaaaaggaguuuuaguagacaguauuauacuaucuuugaaaaucaag

SEQ ID NO: 7129 - RNA, 63 nt, Human
guggaacauaagcaguguuaccccuggcugggagucaguauuauacaacaaauggugagcugg

SEQ ID NO: 7130 - RNA, 61 nt, Human
guggaagcgagccaucgagccauuggcagaaauccugcugaaugucauucagaaaccucag

SEQ ID NO: 7131 - RNA, 63 nt, Human
guggaagggagugccccauccucauuacagaugacacacuggaguguggaggggucgaugacu

SEQ ID NO: 7132 - RNA, 62 nt, Human
guggaagucagugacuuggugacguucuuccuagcaguguuaauacaugcaagaaguaagag

SEQ ID NO: 7133 - RNA, 62 nt, Human
guggaaguuuucccuaugagccuacagucuguauuguuuacauuaagaaacucucuauuauu

SEQ ID NO: 7134 - RNA, 61 nt, Human
guggauaagacaagagggguauuuuggaguccaccugcugagcuggaggccucccacugca

SEQ ID NO: 7135 - RNA, 62 nt, Human
guggauaugaagauguauuuaugguaaaaaaguuaugaaggaaagaaauguuauaugagaga

SEQ ID NO: 7136 - RNA, 63 nt, Human
guggauuaauguggguuuuucuguucauuuuauugcaguauuaaaugcuuaagcuuauuagga

SEQ ID NO: 7137 - RNA, 63 nt, Human
guggcaugaucuugacgugaagcauggguguuuccgugacuuagcugugucccuguagcucug

SEQ ID NO: 7138 - RNA, 61 nt, Human
guggccacauggagaaacaggcaaaccagaaucacugugaaucaagucggugaacugcccc

SEQ ID NO: 7139 - RNA, 62 nt, Human
guggccagcuuguacaccagucccugaacugagcuguuuacaggacuggggaggcuccaccc

SEQ ID NO: 7140 - RNA, 61 nt, Human
guggccccaggcccugguccugccccuguuucuccugcugaccuugggucacaccccuuca

SEQ ID NO: 7141 - RNA, 64 nt, Human
guggccccaggggguuagaggaggggugaagauuggggccaguaucgaucuuaugaagcuggag

SEQ ID NO: 7142 - RNA, 62 nt, Human
guggcuccgugcagcuacagccaggccggcugccucaucucagcucuagggggcacgagcca

SEQ ID NO: 7143 - RNA, 61 nt, Human
guggcugacaggccagccucacucaggcacguaccugcugaccagucagccacugccaacc

SEQ ID NO: 7144 - RNA, 63 nt, Human
guggcuggacuaccgagagcuuggacuacacaauacaguauuauagacaaaagaauaagacaa

SEQ ID NO: 7145 - RNA, 62 nt, Human
gugggagagcagcguuaggcagguggcuugagggugcugcuaaaacagccugugcaguuggg

SEQ ID NO: 7146 - RNA, 64 nt, Human
gugggaugaaaaguggacuuaacuuuuaagguaguuaacuggaauguaaauuuuuaaucuuuau

SEQ ID NO: 7147 - RNA, 62 nt, Human
gugggccccagaccagagaaaagugguaaagaaucuaccucacugggaaugucaucauuacc

SEQ ID NO: 7148 - RNA, 64 nt, Human
guggggaacgucaggucucucugaggucaggucugaggccaguauccuccagcccucccaaugc

SEQ ID NO: 7149 - RNA, 62 nt, Human
guggggaaggugccuauuuuagagaacuuugucacaguauuaaaguucccggggcccacauc

SEQ ID NO: 7150 - RNA, 63 nt, Human
guggggauuguggucacaugaagcucuuucugcaucaguauuaagguguauauuugaaugucc

SEQ ID NO: 7151 - RNA, 61 nt, Human
gugggguggucacauauaguguucucaagcuuuacugugaaucagaaacauccaguaagcu

SEQ ID NO: 7152 - RNA, 62 nt, Human
guggguuuucuguuugaaaaggagucauggcaucuguuuacauuuaccuuaucaaaccuaga

SEQ ID NO: 7153 - RNA, 62 nt, Human
guggguuuugaacauaaagccuuggauguauaugucaucucagugcuguaaaaacuguggga

SEQ ID NO: 7154 - RNA, 64 nt, Human
gugguggcuuuugcaaaaaucuuuauugguguugaaaacuggaaaaaauaacucauccagaauu

SEQ ID NO: 7155 - RNA, 64 nt, Human
guggugugcaaagcauuaugauaggcaccguggggaaacuggaaaugaauuugacaugaaaagg

SEQ ID NO: 7156 - RNA, 61 nt, Human
gugguuaaugaucagaagaugucuccugagccaacugugaaccucacccaggcaaaauggc

SEQ ID NO: 7157 - RNA, 64 nt, Human
gugguugaaaaaaaaagcgggggcaacuugaaauauaugcaguaaaguaguccaugcauacaag

SEQ ID NO: 7158 - RNA, 64 nt, Human
guguaaguguguggauuuuuuuaucauuuuuuuaaaaugcaguacucuuuguaucagucuguca

SEQ ID NO: 7159 - RNA, 62 nt, Human
guguacugaguaugaaaaaucauauuucaaaauccaguguuauucacuaggaugaaugcuau

SEQ ID NO: 7160 - RNA, 63 nt, Human
guguagaagcuuaaauauguaauguaaccaaacuccaguauuaaaaaucucucauguuguuuu

SEQ ID NO: 7161 - RNA, 61 nt, Human
guguauccugaucacaacuccccugcauucauuacugugaaaauuuuugaaucaaaagcaa

SEQ ID NO: 7162 - RNA, 61 nt, Human
guguccccugcagggggcuaaacugcaggggccugagauuagcugugaacaugugggagcc

SEQ ID NO: 7163 - RNA, 62 nt, Human
gugucccuaacagugagguuccaucacaaaggggcaguauuaauuagcagcagcgugcagcu

SEQ ID NO: 7164 - RNA, 61 nt, Human
guguccucagcacccacaaggaauuuuccuaucacugugaacuuugcugguacagaggaau

SEQ ID NO: 7165 - RNA, 62 nt, Human
guguccugaagucgccagaggagaagggaaucauuguuuacacauggggaucagagcagacu

SEQ ID NO: 7166 - RNA, 61 nt, Human
gugugaauauguuggagaggcuuuguguucuucacugugaaaugcaauugugccuugaaua

SEQ ID NO: 7167 - RNA, 61 nt, Human
gugugaauccugagguccauggaggugcagagaugagauuacuccuauucacguugaagug

SEQ ID NO: 7168 - RNA, 64 nt, Human
gugugacugggaaggagaacuuauuccuuaccaggaaacuggaagcuaaaaauacagaggguga

SEQ ID NO: 7169 - RNA, 62 nt, Human
gugugagaggagagaccucuucugcaccgccuggcuaccucacuccucugcugguagcagug

SEQ ID NO: 7170 - RNA, 61 nt, Human
gugugauccgcccgccuccgccuccccaagcgcugagauuacaggugugagccaccgugcc

SEQ ID NO: 7171 - RNA, 63 nt, Human
gugugauucacaccuggcacaacauacuagaauucacacuggagagaaaccgugcaaguguga

SEQ ID NO: 7172 - RNA, 63 nt, Human
gugugauucacaccuggcccaacauacuggaauucacacuggaaaggaacuguacaaguguaa

SEQ ID NO: 7173 - RNA, 64 nt, Human
gugugcuaagaucuagccccauugacucuucuagaaaugcaguauugcuuugaccugccaugug

SEQ ID NO: 7174 - RNA, 62 nt, Human
gugugcuugaauuuaguagcuuacagcauuauuuaugaaggaaaaaauacauaaauaugaag

SEQ ID NO: 7175 - RNA, 64 nt, Human
gugugggggaaagggugguuucuugcuggauuucauggccaguaaguaaauuuaaaugcuucau

SEQ ID NO: 7176 - RNA, 63 nt, Human
gugugggugcuuggaacccgggaugacugagggggacacuggagugggugcuugugucugcug

SEQ ID NO: 7177 - RNA, 64 nt, Human
gugugggugugugauaagcuucucaucccugcauagaugcaguauucuuagccuuaguagaaaa

SEQ ID NO: 7178 - RNA, 63 nt, Human
gugugguaucuagaaauacuuauauauacaauuccacacuggaagacacucagcaauuaauga

SEQ ID NO: 7179 - RNA, 62 nt, Human
guguguccuauacauugccaucaacuuuguuuccucaucucaaauaaaguccuuucagcgau

SEQ ID NO: 7180 - RNA, 62 nt, Human
guguuaacaucuuugaucaguggguguaucuguaaugaaggagguucaagaggcugugcuuu

SEQ ID NO: 7181 - RNA, 62 nt, Human
guguuacuguaauacucuguuuugccuccugccuuguuuacauuaaacaggauauuugguua

SEQ ID NO: 7182 - RNA, 63 nt, Human
guguuagaucuaacguguuccagugucugucugaggugacuuaaaaaaucagaacaaaacuuc

SEQ ID NO: 7183 - RNA, 63 nt, Human
guguucacaacuuccauaagauacugcuaaugcaccaguauuaaaacacaucgacguaaguag

SEQ ID NO: 7184 - RNA, 61 nt, Human
guguucacuucgauuuuucuggucuguggagaaacugugaauuggagaaauggagcucugu

SEQ ID NO: 7185 - RNA, 62 nt, Human
guguucagcaauggugauaaagcagaauauucuccuaccucacgucauuaaagucagaagau

SEQ ID NO: 7186 - RNA, 61 nt, Human
guguucagcuuucuguuuuauauuauuugccauugagauuagaauagaacaggcucuauuc

SEQ ID NO: 7187 - RNA, 62 nt, Human
guguuccucaagcugcacuuuggggccaucucugcaguauuagcccccuuuuugcuuggugg

SEQ ID NO: 7188 - RNA, 61 nt, Human
guguuccuuauuucuuguucccaaacaggauuaacugugaagacuaauuuauaaaugugaa

SEQ ID NO: 7189 - RNA, 61 nt, Human
guguucuaucauuuaaaauauauauuggaaaucccugcugacucagauugguaugauuaaa

SEQ ID NO: 7190 - RNA, 62 nt, Human
guguugauccugguuucccagaucuguauuucaguguuuacaagggaggaaggaccuuuccu

SEQ ID NO: 7191 - RNA, 64 nt, Human
guguugcagcaggcaggcugcuuggagcuucccaugaacuggaaagcucaccuccacugcaucu

SEQ ID NO: 7192 - RNA, 63 nt, Human
guguugggggaaaguuggguaaguuuuuaccaugaacacuggagggaccagcuccucucaggg

SEQ ID NO: 7193 - RNA, 62 nt, Human
guguugggggugggggauugcauggucaauuaaaaugaaggaaugcugaguuuguuuccuua

SEQ ID NO: 7194 - RNA, 63 nt, Human
guguuuaccuaacccagcccuuaauuagggcuucagugacuuagaaaagcaggggaaacccaa

SEQ ID NO: 7195 - RNA, 62 nt, Human
guguuucaacggaaagugcugucuuaaacuaaaugugcaauagaaggugauguugccauccu

SEQ ID NO: 7196 - RNA, 64 nt, Human
guguuuccauuuauuccauguugguguaugggguugaacuggaaaauucccugaggcaaaacuc

SEQ ID NO: 7197 - RNA, 62 nt, Human
guguuuggaacagcucccucaguuucuuucuagcucaucucacucugguaaugucuuucauu

SEQ ID NO: 7198 - RNA, 62 nt, Human
guguuuuaaaccucagaaacagauuugaguguuucaguauuauagaaacagugaugacuauu

SEQ ID NO: 7199 - RNA, 62 nt, Human
guguuuuauuuaucugaaaaaauguaaguaaaagcaguguuagugagaggugcaaagaauua

SEQ ID NO: 7200 - RNA, 63 nt, Human
guuaaaagaugugaguuaaaguuuaugugugugaugugacuuaacuaugcagaaaauauuuaa

SEQ ID NO: 7201 - RNA, 62 nt, Human
guuaaauaucuaacaguuuagaaucuuaugcuuacaguguuaucugugaaugcacauauuaa

SEQ ID NO: 7202 - RNA, 62 nt, Human
guuaaauuuauuuuaacguagacacuaaaaguaugugcaauauacaauuaaaguaggaauuu

SEQ ID NO: 7203 - RNA, 62 nt, Human
guuaacuucagguaaaaacuucauuaggguaauaucaucucaauuuuuucaaaugaaaggau

SEQ ID NO: 7204 - RNA, 62 nt, Human
guuaagcucacccuguucuuugaagcacccaugucaguauuagaagaauaggcagcaguucc

SEQ ID NO: 7205 - RNA, 61 nt, Human
guuaaguuacuugcuucuugggaaucaguguccccugcugagcugaaaaggaaauggauuc

SEQ ID NO: 7206 - RNA, 64 nt, Human
guuaauauuuagagggacuucuagauuuuauaccuaaugcaguagaaccuugaaguauauuuaa

SEQ ID NO: 7207 - RNA, 62 nt, Human
guuacaaaaauaguagaacaagcaacauaaaacaaugaaggaaaaccucacuugaaggccca

SEQ ID NO: 7208 - RNA, 62 nt, Human
guuacaacgaauuuacagucuaguacuuauuacaugcugcuauacacaagcaaugcaagaaa

SEQ ID NO: 7209 - RNA, 62 nt, Human
guuacacacugcccacacucagagcaagaugaguugcugcuauucuuugccugccccugggg

SEQ ID NO: 7210 - RNA, 62 nt, Human
guuacagagugaacacucuacuacaugugacuggcaguauuaagugugcuuauuuuaaaugu

SEQ ID NO: 7211 - RNA, 61 nt, Human
guuaccaauuuaacuaguccugcagaggauuuaacugugaaccuggagggcaagggguuuc

SEQ ID NO: 7212 - RNA, 62 nt, Human
guuacccugucuguaaaaagggaggugagaauaccuaccucacggaacuguugggaggcuca

SEQ ID NO: 7213 - RNA, 64 nt, Human
guuacuauuucuugugguuauaacuuaaugaaaacaaugcaguacaggacauauauuuuuuaaa

SEQ ID NO: 7214 - RNA, 61 nt, Human
guuagauugccaguuccugggaccaggccucagacugugaaguauauauccuccagcauuc

SEQ ID NO: 7215 - RNA, 62 nt, Human
guuagauuuuguguguaacaguguuguaccuggacaguauuagaaauuuguaugcuuauucu

SEQ ID NO: 7216 - RNA, 61 nt, Human
guuagccagugugacuaugcaccuaauuuuuuaugagauuaaauucauaagacuuaauuug

SEQ ID NO: 7217 - RNA, 61 nt, Human
guuauaaaaagaaaaaauaauuuauuuuacaaaugagauuauauuuggagucauguuccaa

SEQ ID NO: 7218 - RNA, 64 nt, Human
guuauagauacagccucuagcucuucagaucuguacaugcaguauuuaauuuccucuuaaacau

SEQ ID NO: 7219 - RNA, 62 nt, Human
guuaucagcucuuuaagagcucuauuaauugccauguuuacaaacaaacacaaagagagaag

SEQ ID NO: 7220 - RNA, 64 nt, Human
guuaugacauaauuuaugucuccauuuuguuguauuggccaguacuuuuacaaaucaaaacauc

SEQ ID NO: 7221 - RNA, 61 nt, Human
guuaugaucauaugaauaaguaaaaaaauucauccugcugauggcaaagagagaggugugc

SEQ ID NO: 7222 - RNA, 62 nt, Human
guuaugguguuuagauuuaugguuguuaaaaaugucaucucaagucaagucacuggucuguu

SEQ ID NO: 7223 - RNA, 62 nt, Human
guuaugucacucgccaagugucuuagucuguuugugcugcuauaacaaaauaccuuagacug

SEQ ID NO: 7224 - RNA, 61 nt, Human
guuauuagaccaguuuuaaaauugucaauaucacaguauuacaggugcuauuuuuuucagu

SEQ ID NO: 7225 - RNA, 62 nt, Human
guuauucaaugauguauauacucccacagcucgcaugaaggaacagccucuauugauacuug

SEQ ID NO: 7226 - RNA, 63 nt, Human
guuauugacaaguuaaaauagcacucucaguuuuucaguauuacagagagcaaauaguuuccu

SEQ ID NO: 7227 - RNA, 62 nt, Human
guuauugcccuuuuauauugugaauguaaugugcauaagcuauauccguagauguuauuguu

SEQ ID NO: 7228 - RNA, 62 nt, Human
guuauuuaaaaacuaacauuugcuauggccaaaguguuuacaauaagcaauaaagugaaaga

SEQ ID NO: 7229 - RNA, 63 nt, Human
guuauuuuauaacugauuuuuaaaaugcuguuuuucaguauuaacuauguugaccuuagaaaa

SEQ ID NO: 7230 - RNA, 62 nt, Human
guuauuuuguuuauuauuuucauguuugaguucugugcaauauuuucuauuauguccguuga

SEQ ID NO: 7231 - RNA, 64 nt, Human
guuauuuuuauuuuggauauagcuuugauguaauuaaacuggaaacucuuuccugaauugucug

SEQ ID NO: 7232 - RNA, 61 nt, Human
guuauuuuucuuaguagggggccuuuggaaggcacugugaauuugcuauuuugauguagug

SEQ ID NO: 7233 - RNA, 64 nt, Human
guucaacuaaucaggaauuaaauggucauuuauuucaugcaguaugauuuaagguauuucuuga

SEQ ID NO: 7234 - RNA, 63 nt, Human
guucacuuugcuguuguagauagccagucaaccagcaguauuagugcuguuuucaaagauuua

SEQ ID NO: 7235 - RNA, 62 nt, Human
guucagagccuggaguuguuaccuuuacuugaagucaucucauccaguccccugcuuuaggg

SEQ ID NO: 7236 - RNA, 62 nt, Human
guucaggggcaguggggggcuccaggcacggucaaugaaggaaacagugccuguccacccac

SEQ ID NO: 7237 - RNA, 62 nt, Human
guucaucuguuuuugaaguguuaccuuacuauuuuguuuacaagauagucuauuggguugau

SEQ ID NO: 7238 - RNA, 62 nt, Human
guuccaggaaaaucuggcuuaaaaauacugguauuguuuacaugaagcagugaaagguuuuu

SEQ ID NO: 7239 - RNA, 61 nt, Human
guuccccuccuggcagucguggccacauugucuccugcugaaccggcucugccccuuucuc

SEQ ID NO: 7240 - RNA, 62 nt, Human
guuccuacggacuucccgacccgcccccuuccaucuaccucagucuuagggggaaagguggg

SEQ ID NO: 7241 - RNA, 62 nt, Human
guuccuaucaucuguggcaugugaagggcaaucacaguguuaaaagaagacaugcugaaaug

SEQ ID NO: 7242 - RNA, 62 nt, Human
guuccucaucuguacaauggggcuuacgauacuacuaccucauaggguuguccuggggaucc

SEQ ID NO: 7243 - RNA, 61 nt, Human
guucuaaaaugucaaggcaguugcuuguguuuaacugugaacaaauaaaaauuuauuguuu

SEQ ID NO: 7244 - RNA, 61 nt, Human
guucuaauagggaagcaauuacugauagaaaugugagauuaaaaauaggguccucccugcu

SEQ ID NO: 7245 - RNA, 62 nt, Human
guucuaaucauuucagcaguagcgucuuaaacagcaguauuacuauaagcaguugcuucaaa

SEQ ID NO: 7246 - RNA, 62 nt, Human
guucuagaguguuuacauacuauuauauaauguacaguguuauuuucuguacuucugaauaa

SEQ ID NO: 7247 - RNA, 63 nt, Human
guucuggggaacagagauucagccaaagucaagaaacacuggaugccagcuagauuaucuguu

SEQ ID NO: 7248 - RNA, 64 nt, Human
guucuguuacccaauuuagauuaguaaagcguacacaacuggaaagacugcuguaauaacacag

SEQ ID NO: 7249 - RNA, 62 nt, Human
guucuuagcucaaugagcauguuuagacuuuaacauaagcuauuuuucuaacuacaaagguu

SEQ ID NO: 7250 - RNA, 61 nt, Human
guucuuauuuucauacauauugguaugcaccaaacugugaaugcauccagcuguuggaaaa

SEQ ID NO: 7251 - RNA, 62 nt, Human
guucuucuaaagccuacguugguuaggcugauggcaguauuauaguugcuaaauucagcacu

SEQ ID NO: 7252 - RNA, 64 nt, Human
guucuuuuauucagagcaauguuucuuguauucugaaacuggaaacugaaccaguuuguuucuc

SEQ ID NO: 7253 - RNA, 62 nt, Human
guugaaacuguuaaaauuccaauuuguuuucauucaguauuaguuuaguucuaaauauagca

SEQ ID NO: 7254 - RNA, 61 nt, Human
guugaagcuaauguugagacugagacuuacgaaacugugaaucccacugggaaaaagacuu

SEQ ID NO: 7255 - RNA, 64 nt, Human
guugaauuuauagagcauuuuuuuucuuaccaagauggccaguaucauuuuacccccaccuccc

SEQ ID NO: 7256 - RNA, 61 nt, Human
guugagaucuacagagauccaggaaaccaaagcccugcugagcagagccauuuuguggcua

SEQ ID NO: 7257 - RNA, 62 nt, Human
guugaggagguuucugcauagagucuuuauguccauaagcuacggguaggucuauuuucaga

SEQ ID NO: 7258 - RNA, 63 nt, Human
guugagggaccuuggaggaugaaggcgaguaugugacacuggagaaaaguggaccaggcaugu

SEQ ID NO: 7259 - RNA, 64 nt, Human
guugagggcuuauucagugggggaggugcacggcagggccaguacccuuggagggucaggccac

SEQ ID NO: 7260 - RNA, 63 nt, Human
guugaugucagguauuuacagugguuggaagauagcaguauuauuagcauaagcugcauacgu

SEQ ID NO: 7261 - RNA, 60 nt, Human
guugcaguuaaagacuuaaggaacaacuugugccugcugacuaauacauuuuaucaccca

SEQ ID NO: 7262 - RNA, 62 nt, Human
guugccucuucuauaacauggaugcuaauaguaccuaccucauagaauuguuuuggaaguaa

SEQ ID NO: 7263 - RNA, 64 nt, Human
guugcuaugggcccuucaccaacaugcccacagaucaacuggaauggaugguacagcugugugg

SEQ ID NO: 7264 - RNA, 62 nt, Human
guugcuauguugauguguaagugaaaucaguugugugcaauagacaggggcguauucauggg

SEQ ID NO: 7265 - RNA, 63 nt, Human
guugcugaguggcugguccaugucuauagaguaacacacuggaccgaggaaaagucagauuuc

SEQ ID NO: 7266 - RNA, 62 nt, Human
guugcuguugcuguugcuguugcuguuggcaucuugcugcuaauccugaggcugguagcaga

SEQ ID NO: 7267 - RNA, 62 nt, Human
guuggaaguuuucagaauaaccagaacuaaggguaugaaggaccuguauuggggucgaugug

SEQ ID NO: 7268 - RNA, 62 nt, Human
guuggacaucuuuucucuuguguuuuguuugaaugugcaauaguuuauaggccacaaauaag

SEQ ID NO: 7269 - RNA, 55 nt, Human
guuggcaccaaaaagcuaggguuuugucuaccucaguucuugucauaccaaucuc

SEQ ID NO: 7270 - RNA, 62 nt, Human
guuggucuugaacuccuggccucaagcgauccgccuaccucagccucccaaagugcuaggau

SEQ ID NO: 7271 - RNA, 61 nt, Human
guugguuagcagggaagacccagaguuguagauugagauuaggguguacuggcugaacugu

SEQ ID NO: 7272 - RNA, 62 nt, Human
guugguucguuauuuuuuaagauuagccauucucugcugcuauuucccuacauaaugucaau

SEQ ID NO: 7273 - RNA, 62 nt, Human
guuguaaaagccauauuucuaauggaaaaucagguguuuacaggaaagaucucagaggcuau

SEQ ID NO: 7274 - RNA, 61 nt, Human
guuguaauuucauccaaauuugaucuguuuccaccugcugaauggugcucugacaauaaug

SEQ ID NO: 7275 - RNA, 63 nt, Human
guuguagacucacaaguuuaacuguuguauuauaacaguauuacaugucaacggugugguuau

SEQ ID NO: 7276 - RNA, 64 nt, Human
guugucauuauucagcucccacuuguaagugagagcaugcaguauuucauuuucuauuucugug

SEQ ID NO: 7277 - RNA, 64 nt, Human
guugugucucucucugucagcgaauccacugcgguuaacuggaaaagaaagacaacagugucag

SEQ ID NO: 7278 - RNA, 62 nt, Human
guuuaaaaaaaauaaauaaaaauuaaaaaaaucugugcaauaauuuuaaaaugugcucccag

SEQ ID NO: 7279 - RNA, 62 nt, Human
guuuaaaaucaagaguguauuguuuacuguuuuacaguauuauuuaauauccaacuggucuc

SEQ ID NO: 7280 - RNA, 61 nt, Human
guuuaaagauuagcuuugcaugauccuuuaugcacugugaaggucugaaguuuauaauacu

SEQ ID NO: 7281 - RNA, 61 nt, Human
guuuaaagccuaccaguguaaccuaccaguacaacugugaauccuaggcaaggcaaaaaug

SEQ ID NO: 7282 - RNA, 62 nt, Human
guuuaacauaauaauguuuuaaagacuuaguugucaguauuaaauaauccuggcauuauagg

SEQ ID NO: 7283 - RNA, 61 nt, Human
guuuacauugcagauugcuauaauuucaaggagugagauuauaaauaaaaugaugcacuuu

SEQ ID NO: 7284 - RNA, 64 nt, Human
guuuacauuuguauuuuuccagaauucuuuuguccuaugcaguauugcuaaagucgagaauaua

SEQ ID NO: 7285 - RNA, 62 nt, Human
guuuagauguugccuuuacaguugccuuucaauucaguguuauacuguguguagguaaaaca

SEQ ID NO: 7286 - RNA, 62 nt, Human
guuuauacuccaguguacauaguguaauguagcguguuuacauguguagccuauguuguggu

SEQ ID NO: 7287 - RNA, 63 nt, Human
guuuauauaucacuauaaaauccaguugaccuggacaguauuauauguacauaucuauucuaa

SEQ ID NO: 7288 - RNA, 62 nt, Human
guuuaugcugugauuucacucugucuaucaugggcaguauuagaaaacacacugguuuucac

SEQ ID NO: 7289 - RNA, 62 nt, Human
guuuauuaugcaacucuggagguauagagggcauauaagcuaugggacauaugcugaucaca

SEQ ID NO: 7290 - RNA, 62 nt, Human
guuucaaaaaagauuuuauuugaagaaauacuucugcugcuacaaaguuugaaaguuacuau

SEQ ID NO: 7291 - RNA, 61 nt, Human
guuucaaaugaaacuacaaaucuggcauguuuuacugugaacacuuuuguuauuuguuuug

SEQ ID NO: 7292 - RNA, 61 nt, Human
guuucaugcuuauuuauaggaaaguuauauuaaugagauuaauaaugugaaauacaguuuu

SEQ ID NO: 7293 - RNA, 63 nt, Human
guuucauuguuaauugguuugggagccuccuaugugugacuuaugacuucucuguguucugug

SEQ ID NO: 7294 - RNA, 62 nt, Human
guuuccagccugagccuggugcuugaacagacgugugcaauaaaugcucguuaaaugaugcc

SEQ ID NO: 7295 - RNA, 61 nt, Human
guuucuaucugucuuguuuuucacuuauauaacacugugaacuucuaaagcaagaggauaa

SEQ ID NO: 7296 - RNA, 62 nt, Human
guuucucgacuuguauuuauuaaauacucaaacucaguauuaccuacucaaugccuuuuaaa

SEQ ID NO: 7297 - RNA, 61 nt, Human
guuucuggaggcagcuggucccccacaccgcguccugcugagccugcccccuggauuggcu

SEQ ID NO: 7298 - RNA, 62 nt, Human
guuucugugaucucugaggucuauuuuauguuuuugcugcuacuucuguggaaguagcuuug

SEQ ID NO: 7299 - RNA, 62 nt, Human
guuucuucaguggcaaauguagcccugcauccuccaguguuaccugguguagauuuuuuuuu

SEQ ID NO: 7300 - RNA, 62 nt, Human
guuucuugacucagacuuuacugguaggguuacuucaucucaugaaaugacagaacugucuu

SEQ ID NO: 7301 - RNA, 62 nt, Human
guuugagguaguuguccguuugagucaugggcaaaugaaggacuuuggucauuuuggacacu

SEQ ID NO: 7302 - RNA, 62 nt, Human
guuugaugucauuuaagaauuacuaacacaguggcaguguuagaugaagaugcugucuacaa

SEQ ID NO: 7303 - RNA, 62 nt, Human
guuuggggauucauugcugcuagauuauaucagguguuuacauagugucuacuauaugcugu

SEQ ID NO: 7304 - RNA, 62 nt, Human
guuuguaacugugauuaugauagaggccuaucucuguuuacaugcauagcuuugaguuaggc

SEQ ID NO: 7305 - RNA, 62 nt, Human
guuuguuaaaaggcuacacgagcucucuagaaacugcugcuacuagaaaugucuaaacuaua

SEQ ID NO: 7306 - RNA, 64 nt, Human
guuuguuucaugacaaauuauauagucuauaaauuaaacuggaaguaauuauuugggcuuuugc

SEQ ID NO: 7307 - RNA, 62 nt, Human
guuuuaauggauuauuuuuaaugaaauguuuuauuguuuacaaacgguauguugcuguguac

SEQ ID NO: 7308 - RNA, 62 nt, Human
guuuuaauguauaauaauaaaauugccuuuugcauuccguuagugacugauuguuaaaaaua

SEQ ID NO: 7309 - RNA, 64 nt, Human
guuuuaauuucuccauuuguaauagcuggguauuuaaacuggaagcaaauaguuuucuuucuua

SEQ ID NO: 7310 - RNA, 62 nt, Human
guuuuacuguaaugguaaggauugacucaagagacaguauuaguaaauuuauuguguaugga

SEQ ID NO: 7311 - RNA, 63 nt, Human
guuuuagaaaacaaagcauuaaaaaaaaagccuaucaguauuaugggcaauauguaaauaaau

SEQ ID NO: 7312 - RNA, 62 nt, Human
guuuuccagagccuuaaacuguccuaagugacaacuaccucaguuggcaggaaagagacaua

SEQ ID NO: 7313 - RNA, 62 nt, Human
guuuuccuuagaaaaagcuuuugcuaucuuauccuguuuacauuauuucuuuauuuuaauuc

SEQ ID NO: 7314 - RNA, 64 nt, Human
guuuuccuucuaggugcuguuccgguggauucugaaaugcaguagagggcuuuuguuggcagaa

SEQ ID NO: 7315 - RNA, 62 nt, Human
guuuugaaaggaguuuugacuuuuuuccccucauucaucucaguauagagugcgcuauuuca

SEQ ID NO: 7316 - RNA, 62 nt, Human
guuuugaugugucugauuuugacuacucaagcucuguuuacagaagaaaauugaauggcgag

SEQ ID NO: 7317 - RNA, 62 nt, Human
guuuugcauacgguuuuguuuggaggauggcuucugcugcuaaaaauacaaaaguuuggaaa

SEQ ID NO: 7318 - RNA, 62 nt, Human
guuuugcauguagaucaauuuaaaauguaccucuuguuuacauaauuugcauaauuuuaaaa

SEQ ID NO: 7319 - RNA, 62 nt, Human
guuuugccuaccugguccuuacacuacaucaucaucaucucaugcccaccugcccacaccca

SEQ ID NO: 7320 - RNA, 62 nt, Human
guuuuggcucucccaccccgccguucccugcgcuucaucucaugaggauuucuuuaugaggc

SEQ ID NO: 7321 - RNA, 62 nt, Human
guuuugggaugucagcaguggccugaagugaguugugcaauaaauguuaaguugaaaccucu

SEQ ID NO: 7322 - RNA, 62 nt, Human
guuuuguaucgggaauuucucagagcugaguaaaaugaaggaaaagcauguuauguguuuuu

SEQ ID NO: 7323 - RNA, 62 nt, Human
guuuugugagguaauacugauuuugaaaauauauauaagcuaaaaacaguauuucguugaua

SEQ ID NO: 7324 - RNA, 62 nt, Human
guuuuguuucaaacuuuucugucaucugucucuacuaccucagaaacugcagcuugguucug

SEQ ID NO: 7325 - RNA, 62 nt, Human
guuuuguuuguaaaauacauaauuaauauuugaccuaccucaaaauguauugaggaucugug

SEQ ID NO: 7326 - RNA, 63 nt, Human
guuuuuaacagaacguguauuuauuaauguucaaaacacuggaauuacaaaugagaagagucu

SEQ ID NO: 7327 - RNA, 63 nt, Human
guuuuuaacaugguauuuuugaaggagcuaaugaaacacuggacauauaauugguuuaaacau

SEQ ID NO: 7328 - RNA, 62 nt, Human
guuuuuaauguaacaccauuagacacucaccagauguuuacaaguuuucuuuaggggaacua

SEQ ID NO: 7329 - RNA, 61 nt, Human
guuuuuauauaaaaacaaugauaaagaugugaaacugugaaauaaauauaccauauuagcu

SEQ ID NO: 7330 - RNA, 64 nt, Human
guuuuuauauaucauuguguaaauuuaauauaacauaugcaguaauaaaccauuuguuuuacug

SEQ ID NO: 7331 - RNA, 62 nt, Human
guuuuucagggcaggucuguacuguguguagugcuguuuacauagaugaauuuagguuguaa

SEQ ID NO: 7332 - RNA, 62 nt, Human
guuuuucuauguaaauauugaaaacuuaugauuugugcaauaacucagauauuuuuuauuua

SEQ ID NO: 7333 - RNA, 62 nt, Human
guuuuucuguguuguuuucccuggaugaaaauaucaguauuaaguagacagcauauuauuca

SEQ ID NO: 7334 - RNA, 62 nt, Human
guuuuucuguugaaacuagaggguuuuuuuuuucuguuuacauauacuuuuuuuuaauagca

SEQ ID NO: 7335 - RNA, 62 nt, Human
guuuuucuuacugucacuucuaaauagaaaaugacaguguuauaaaaaagggaaggauaaaa

SEQ ID NO: 7336 - RNA, 62 nt, Human
guuuuuggaaacuuagaaaagagggaaaaaaauccaguguuacuaguaauuuccaugguaau

SEQ ID NO: 7337 - RNA, 62 nt, Human
guuuuuguuuuuaccuuggcuuuuguuuuucucauguuuacagugcacggaguguggaaggg

SEQ ID NO: 7338 - RNA, 62 nt, Human
guuuuuguuuuuuaaguagccacuuuuaauuacucaguauuaauccuaggugcauguguuaa

SEQ ID NO: 7339 - RNA, 63 nt, Human
guuuuuucaaaaaugaauuuuuauuuaaugugguucaguauuauaauaacaaagcauuuuugu

SEQ ID NO: 7340 - RNA, 62 nt, Human
guuuuuuccucuuugguccuucuaucacuaaaacucaucucauucagccuuacagcauaacu

SEQ ID NO: 7341 - RNA, 61 nt, Human
guuuuuucuuugggugugugcugauccuguuacugagauuaauuacauggcucugcagugu

SEQ ID NO: 7342 - RNA, 64 nt, Human
guuuuuugggguguuuugagaaaguggcauggaaacaugcaguaguuaaugaguuucucuuggu

SEQ ID NO: 7343 - RNA, 62 nt, Human
guuuuuuucaugaguuucucauccuggcauguuuuguuuacaauagcuuuugauguuuguau

SEQ ID NO: 7344 - RNA, 62 nt, Human
guuuuuuuuauccuacugcucauuuuuaggucuguguuuacaucuagucucuacuauuugug

SEQ ID NO: 7345 - RNA, 62 nt, Human
uaaaaacaucagucccgaggaggggacaacaauacuaccucacuacuacaucugugaugacu

SEQ ID NO: 7346 - RNA, 63 nt, Human
uaaaaagagcacccucauucaacauucgugagaucacacuggaaagcacuuaugaguauggag

SEQ ID NO: 7347 - RNA, 62 nt, Human
uaaaaagauaaccauacuauacauagaaagccaaucaucucagccaugauuaucucagaaau

SEQ ID NO: 7348 - RNA, 63 nt, Human
uaaaaaucaaaacuuaaaauucuaaccagucauauacacuggauaauuugguaagaaaacugu

SEQ ID NO: 7349 - RNA, 61 nt, Human
uaaaaaugaacaucgcauuuucuuugauuuuggacugugaacuuauuuucagagaugaaua

SEQ ID NO: 7350 - RNA, 62 nt, Human
uaaaaauuuuaucgcuguuaagguauuaaucauucaguauuacuaauggaauagaaauucau

SEQ ID NO: 7351 - RNA, 62 nt, Human
uaaaacaaaacaaaacaaaaaaaacuugugccugauaagcuaaggcucauuuauuuuuaaaa

SEQ ID NO: 7352 - RNA, 62 nt, Human
uaaaacaauucuauuucauagcacaucacaauacugcugcuacucuguagccacccccaugg

SEQ ID NO: 7353 - RNA, 63 nt, Human
uaaaacaguugccucaagcuucugucuuaagaguagugacuuagaauccagauaucuuuuguu

SEQ ID NO: 7354 - RNA, 62 nt, Human
uaaaacauaccauccuuuucuauuuucuugaugcuguuuacaacauaguuuggugauaucca

SEQ ID NO: 7355 - RNA, 62 nt, Human
uaaaaccauaaacauuugccaaaaauucaugccccaguauuagcaaugaauuaguugcauug

SEQ ID NO: 7356 - RNA, 61 nt, Human
uaaaaccuugucauuuuaccccaucccugcaugacugugaagcuggcgaggaaggaggaag

SEQ ID NO: 7357 - RNA, 61 nt, Human
uaaaagaacauuggguuaaugcagccuugguuuccugcugagcuccaguauuuugauaguu

SEQ ID NO: 7358 - RNA, 62 nt, Human
uaaaaggaaguuuaauguccguuguaucacaaaucaguguuaaaacaccagaacuuuagcca

SEQ ID NO: 7359 - RNA, 62 nt, Human
uaaaaguguaagauacuaaguguguagaauaaaagugcaauaacaaaagacaaugacuuugg

SEQ ID NO: 7360 - RNA, 62 nt, Human
uaaaaguucugccauguuaaguggccagcauuucaugaaggauaacauuuuuauacagaagg

SEQ ID NO: 7361 - RNA, 62 nt, Human
uaaaauaaacucuucuuuuuuucuuuaaaguauacuaccucaaaacucauuauguugucaga

SEQ ID NO: 7362 - RNA, 62 nt, Human
uaaaauauuuuuaugacuacagauuuugcauuuuuguuuacaacuauuuaaagaguuuuaug

SEQ ID NO: 7363 - RNA, 64 nt, Human
uaaaauuaguauauuuuacuaauacuuuuauauaaaaugcaguauauuuuuuaaauuucagauu

SEQ ID NO: 7364 - RNA, 61 nt, Human
uaaaauuaucauuaauaauauaaaacacuuauuugagauuaaauuaaauuuuucaugagcc

SEQ ID NO: 7365 - RNA, 62 nt, Human
uaaaauuuugaguuaaguugcauuucuuugggcuaugaaggaguccucuuaaguuugauaga

SEQ ID NO: 7366 - RNA, 62 nt, Human
uaaacaaaaugacacagaaaugcacaguguuguuaugaaggagccuguuuaccuguguucaa

SEQ ID NO: 7367 - RNA, 62 nt, Human
uaaacaucaacuuuacuuucuagguaauguggcugugcaauauuuuuuuaauuuuaucuuuu

SEQ ID NO: 7368 - RNA, 62 nt, Human
uaaacauucacugauauucuuacagguugguuugcaguguuaacauuuuuguuagccugauc

SEQ ID NO: 7369 - RNA, 61 nt, Human
uaaacauuuagcgugcgguuucccaucaguuuuacugugaaugugaaaaggugaaacuguu

SEQ ID NO: 7370 - RNA, 61 nt, Human
uaaaccuggaacuccuuaaaugggguaggugggugagauuaucaaagcugaagcuggcuuu

SEQ ID NO: 7371 - RNA, 62 nt, Human
uaaacugaaaaaugucagucugguuuauauaaggcaguauuauugagcucuauuuccccacc

SEQ ID NO: 7372 - RNA, 62 nt, Human
uaaacuucuguaaccuaugcauauuuuaugggggcaguauuauuacaaauggaucugaaaug

SEQ ID NO: 7373 - RNA, 62 nt, Human
uaaacuugauuuaauaaaaauuaaauaucauuuuuguuuacaccaaaauuaucagaaguagg

SEQ ID NO: 7374 - RNA, 62 nt, Human
uaaagaaaggauauuuuaauaaguucuuucugcuugcugcuaagaguuugcuaaagugucau

SEQ ID NO: 7375 - RNA, 62 nt, Human
uaaagaauagaccaugggcuacuacugggcauuagugcaauauaacagcgauaauaaaauuc

SEQ ID NO: 7376 - RNA, 64 nt, Human
uaaagacaccaccuuccugccagcuguuugcccuuaggccaguacacagaauuaaaguggggga

SEQ ID NO: 7377 - RNA, 62 nt, Human
uaaagaugugcaaccuaugcgcccccugcccuacuuccguuacccugagagucggugugugg

SEQ ID NO: 7378 - RNA, 62 nt, Human
uaaagcaucuaaacuuuaauauguauuuuauguauguuuacacugucaaacaucuggaaaau

SEQ ID NO: 7379 - RNA, 61 nt, Human
uaaagcaugacuuucaaggaugguucuuaggggacugugaaaguguugggucuuccuccag

SEQ ID NO: 7380 - RNA, 62 nt, Human
uaaagccugcaucuggcuacccuggggcgaguccuguuuacagugccuauuccuggagcucg

SEQ ID NO: 7381 - RNA, 64 nt, Human
uaaaggagaaucugaaggcaggucagggaaaagaagaacuggaaaugaaacagaggacagguga

SEQ ID NO: 7382 - RNA, 61 nt, Human
uaaagguggcugaguggauuugcaugcuuuagaacugugaauagaguucuaacugaaacca

SEQ ID NO: 7383 - RNA, 62 nt, Human
uaaagguguuaauuaauggguauaaaauuuaaaucaguauuacuggcagacguuauuuuagg

SEQ ID NO: 7384 - RNA, 61 nt, Human
uaaaguauaccaaacuguaacuuaccuaguaaaugagauuagaaacuauugucagggucau

SEQ ID NO: 7385 - RNA, 62 nt, Human
uaaauaaaauuuuguuuuucuguaaugucauauuugcugcuacaguagcucaauauuuuaca

SEQ ID NO: 7386 - RNA, 62 nt, Human
uaaauaaauaccagguaugaaauuacugauuuuagugcaauaucuguaugauuauccagaac

SEQ ID NO: 7387 - RNA, 62 nt, Human
uaaauaaauauuuauuuauuuauuuauaaguagauguuuacauaugcccaggauuuugaaga

SEQ ID NO: 7388 - RNA, 62 nt, Human
uaaauagagaaaaagugugugugagcaauaaugcauaagcuacugauaacuugcuuacagca

SEQ ID NO: 7389 - RNA, 62 nt, Human
uaaauagccacaguccuuaagccacacacauuguugcugcuaugacuuuuuaccuccuuuaa

SEQ ID NO: 7390 - RNA, 62 nt, Human
uaaauauaaucuuaaaguauguuuguaucuguaacaguguuagaccagauuugguuucuacc

SEQ ID NO: 7391 - RNA, 64 nt, Human
uaaauauacuccuaguaauuuaagauuuuguuuuuaaacuggaaauaaaagauuguauagugca

SEQ ID NO: 7392 - RNA, 64 nt, Human
uaaaugcacaacaagcaaaugaauuuaagagaacuaaacuggaauaaguguucauaaaugaaac

SEQ ID NO: 7393 - RNA, 61 nt, Human
uaaauggggugauggguggccaauaccacaauuccugcugaaaaacacucuuccaguccaa

SEQ ID NO: 7394 - RNA, 62 nt, Human
uaaaugucucuugcaaaacaaaguaagauaccaccaguauuacaacacaaugauuuuccaga

SEQ ID NO: 7395 - RNA, 64 nt, Human
uaaauuauggauaacucgaaagacagcucaggugaaggccaguaaugauuuuuuugaaguuuca

SEQ ID NO: 7396 - RNA, 62 nt, Human
uaaauuccaauuucuauuuacuuauucauugugacaguauuacuaaacagguaaggauggga

SEQ ID NO: 7397 - RNA, 61 nt, Human
uaaauuguguuuccagagaaagaggagaaaccuugagauuacugauuacauaaagcaaaua

SEQ ID NO: 7398 - RNA, 62 nt, Human
uaacaauacagaggaacuagcuguguuacugcaccaguguuauagguaacuucaguauauua

SEQ ID NO: 7399 - RNA, 62 nt, Human
uaacaauucuucauuuaccuaguauuaugaaagaaugaaggaguucaaacaaauguguuucc

SEQ ID NO: 7400 - RNA, 62 nt, Human
uaacacuauguuuagcuguguuuaugcuauaaaagugcaauauuagacacuagcuaguacug

SEQ ID NO: 7401 - RNA, 62 nt, Human
uaacacuuccaaauaugggaggaaaggacagauguguuuacaagggaggauuuuacaacaua

SEQ ID NO: 7402 - RNA, 62 nt, Human
uaacagaaaagauauuuauuggccaggaaguuggugcugcuaagaccgagaaauuuaaagaa

SEQ ID NO: 7403 - RNA, 62 nt, Human
uaacaguagcuuguagagauccagugcacgccgaugcugcuaaacucagugccugagcccgg

SEQ ID NO: 7404 - RNA, 62 nt, Human
uaacauacuguauacucuauagcaguauuacagucaguauuucauauaauuuucuuuagacc

SEQ ID NO: 7405 - RNA, 61 nt, Human
uaacauuucgcuacuaaaagcuagaaaggaugaacugugaaagguucuaggcagcucugug

SEQ ID NO: 7406 - RNA, 62 nt, Human
uaacauuugaguuuguuuaagguauaagcagaagauaagcuaauauagcuuguuuuguugaa

SEQ ID NO: 7407 - RNA, 62 nt, Human
uaaccagaugcagcaaauaucuaggcaauguggacuaccucauucaguaacugauugucaaa

SEQ ID NO: 7408 - RNA, 62 nt, Human
uaacccuugccuuccugucacaggguuugcuuguugcugcuauaguuuuuaacuuuuuuuua

SEQ ID NO: 7409 - RNA, 63 nt, Human
uaaccgcgcaguucauuggccacucugcacgcauucaguauuaccauggagcugggaaucuug

SEQ ID NO: 7410 - RNA, 64 nt, Human
uaaccuaauuuuccugggacugccauauuuucuuuuaacuggaaauuuuuaugugaguuuuccu

SEQ ID NO: 7411 - RNA, 64 nt, Human
uaacuaaugggauccagcagggccauuucuccagagggccaguauccuauuaggagacucuugg

SEQ ID NO: 7412 - RNA, 63 nt, Human
uaacucuuggcauuauacgucucccuuuuucuuuacaguauuaguaaaaagaaaaauuguaca

SEQ ID NO: 7413 - RNA, 62 nt, Human
uaacugacuuucuagaugccuuaauauuugcaugauaagcuaguuuuauugguuuaguauuc

SEQ ID NO: 7414 - RNA, 62 nt, Human
uaacugcucaguagguuacaaaugaagaguccaccaguauuagaaacaauuuaaacuugcca

SEQ ID NO: 7415 - RNA, 63 nt, Human
uaacugggucuuucagauagcaaagcaaucuauaaacacuggaaacgcuggguucagaaaagu

SEQ ID NO: 7416 - RNA, 62 nt, Human
uaacuuauuuauguccuaaaagaagaauguaauuuguuuacaaaccuguagauaacgucuuu

SEQ ID NO: 7417 - RNA, 61 nt, Human
uaagaaauaauauuuauauuucuguaaauguaaacugugaagauaguuauaaacugaagca

SEQ ID NO: 7418 - RNA, 62 nt, Human
uaagaauguuauccaacuauuaagauaucucaaugugcaauaacuuguguauuagauaucaa

SEQ ID NO: 7419 - RNA, 63 nt, Human
uaagacaacaacuaaaaaaaaugcaaggaauauguacacuggaacuguagugguagcuuucag

SEQ ID NO: 7420 - RNA, 63 nt, Human
uaagagaggagaguucaguaccccgugcuuucuuuacacuggagaggaacuaaaaggaucucu

SEQ ID NO: 7421 - RNA, 63 nt, Human
uaagagauugacaacaauaacuaauaauaaaauguaacgguuauacuguccugcagcugugag

SEQ ID NO: 7422 - RNA, 61 nt, Human
uaagauaccaacuucaacacuguaauaacauauacugugaaaacauuccuaaaaaguaacc

SEQ ID NO: 7423 - RNA, 62 nt, Human
uaagauauauguauauaaaguguaugcuguauuggugcaauaaugguaauuaaaaauaugaa

SEQ ID NO: 7424 - RNA, 62 nt, Human
uaagaucacaugaggguaguauuuaauauauuagaugaaggacaacuuuggacauaacacug

SEQ ID NO: 7425 - RNA, 64 nt, Human
uaagcaagaacuaauggcuaaauuaucaacuuggaaaacuggaaaaucuggauggcagagaaau

SEQ ID NO: 7426 - RNA, 61 nt, Human
uaagccaacaccagcgugccgcggccugcacacccugcugacaucccaggcacgagggugu

SEQ ID NO: 7427 - RNA, 63 nt, Human
uaagccauuggauaauacugaaucuguuucccuaagugacuuaaccuuagagcaagcacaaca

SEQ ID NO: 7428 - RNA, 62 nt, Human
uaagcugcuaauuguaaacaaaacaguuacccuccaguauuaauaugacucauuagugugag

SEQ ID NO: 7429 - RNA, 63 nt, Human
uaagcugggcauggucgcucaggccaguaaucccagugacuuaggaggcugaggugggaggau

SEQ ID NO: 7430 - RNA, 64 nt, Human
uaaggaggggaaaaaaauguuguuuccuaauaucaaaugcaguauauuucuucguucuuuuuaa

SEQ ID NO: 7431 - RNA, 62 nt, Human
uaaggauggagaggagggagagccagaaaaauauaugaaggagaggaggguaaaggagaaug

SEQ ID NO: 7432 - RNA, 63 nt, Human
uaaggcauuucauacuagucuccucuaguagaccugugacuuacuguguuggacauauuauuu

SEQ ID NO: 7433 - RNA, 62 nt, Human
uaaggugcuuugaagaggaagccauuauggauggaugaaggauaguaaugcaauaccuccac

SEQ ID NO: 7434 - RNA, 64 nt, Human
uaagguuguaauguuuuucuccgaguugucagaaauaacuggaagaauacaauauauggccauu

SEQ ID NO: 7435 - RNA, 64 nt, Human
uaagguuuuacugagcacagccacacucauuuguuuaugcaguacggccugacauugcuuuugc

SEQ ID NO: 7436 - RNA, 64 nt, Human
uaaguauuauuuaaacagaaaagugucagaaaucaaaugcaguaucucccucucccuuuuuuaa

SEQ ID NO: 7437 - RNA, 62 nt, Human
uaagucaugacacaguauucgcucuuuuucugaauguuuacauagagauucaucacugcaga

SEQ ID NO: 7438 - RNA, 61 nt, Human
uaagugauugacuucuuuuuaguuccaugaucuugagauuauuuuuagcuuuauaaauuua

SEQ ID NO: 7439 - RNA, 62 nt, Human
uaaguguccacaucuagaaggcucucauugcaguuguuuacaguuaagguaccucuaucuaa

SEQ ID NO: 7440 - RNA, 62 nt, Human
uaagugugcuguaaggaaaagucuuagaaacauaauaagcuaaaaucccauucacacauggc

SEQ ID NO: 7441 - RNA, 63 nt, Human
uaaguguuuuuacaaguuuguguuuuauuuauggagugacuuaucccuuccauucagagcagc

SEQ ID NO: 7442 - RNA, 61 nt, Human
uaauaaaacugcgaggacaucaaagugguaaauacugugaaauaccuuuucucacaaaaag

SEQ ID NO: 7443 - RNA, 63 nt, Human
uaauaaguaaauugauuuccuaaucacaauucuaugugacuuauggucaaaagagcaguuuua

SEQ ID NO: 7444 - RNA, 62 nt, Human
uaauaauacuuauguuaauaacucuaugaaacauauaagcuaacuauauaucaaacauuuca

SEQ ID NO: 7445 - RNA, 62 nt, Human
uaauacagcugcuaaaaugaucccugucuccucguguuuacauucuguguguguccccuccc

SEQ ID NO: 7446 - RNA, 64 nt, Human
uaauaggaaaguuguauuaauucaguauuugucauuaugcaguauuuuaauaccuacauaaguc

SEQ ID NO: 7447 - RNA, 62 nt, Human
uaauaguuguuuacuagugugcuagaugaaaagcgugcaauaugcuuuaaagcuaucaacaa

SEQ ID NO: 7448 - RNA, 62 nt, Human
uaauaucagauauuacggauguuagauugcaucucaguguuaaaucuuuacugauagaugua

SEQ ID NO: 7449 - RNA, 61 nt, Human
uaauaugucuccaaaacugaacugauugcuuguugagauuaccuagaaagcuuuuggaaaa

SEQ ID NO: 7450 - RNA, 62 nt, Human
uaauaugucuuaauuuugaguuugaaaauguuaagugcaauaaaaacauacuaguacagauu

SEQ ID NO: 7451 - RNA, 62 nt, Human
uaaucagauuaagauugaccauugcuccuuuacacaguauuagucuagcauucaauuauuuc

SEQ ID NO: 7452 - RNA, 63 nt, Human
uaaucauauauaugcauacguaaaaauggaccacagugacuuauuuguaguuguuaguugccc

SEQ ID NO: 7453 - RNA, 63 nt, Human
uaaucccagcacuuugggaggcugaggcaggaagcacacuggagcccaggaguuugagaccag

SEQ ID NO: 7454 - RNA, 62 nt, Human
uaaucccauugcaaacauuauuccaagaguaucccaguauuagcaauacuggaauauaggca

SEQ ID NO: 7455 - RNA, 64 nt, Human
uaaucccugucuggacugagccuccguuggcuucugaacuggaauucugcagcuaacccuucca

SEQ ID NO: 7456 - RNA, 64 nt, Human
uaaucgacuggacugcagauguuuuuucuuuuaacaaacuggaauuuucaaacagauuaucugu

SEQ ID NO: 7457 - RNA, 62 nt, Human
uaaucuaggagcgacaguucgugagauguuuauucaguguuaaagagccuguuuuucuacca

SEQ ID NO: 7458 - RNA, 62 nt, Human
uaaucuggcacaacacuaauuaccauuuuuaaagcaguauuaaguuguaauuuaaaccuugu

SEQ ID NO: 7459 - RNA, 61 nt, Human
uaaucuuccccuuuuaugugaaaaguuuugagaacugugaaauguuuaggaacaaacuguu

SEQ ID NO: 7460 - RNA, 63 nt, Human
uaaugagcauuuaaaugcaacagauaucauuucaggugacuuaacaugaaugaauaaaaguca

SEQ ID NO: 7461 - RNA, 62 nt, Human
uaaugauuacaguuuucauuuuuaaaaauuuaggaugaaggaaacaaggaaauauagggaaa

SEQ ID NO: 7462 - RNA, 63 nt, Human
uaaugcagaaacuaagcuuauuauucugaguuugaacacuggauucguauggcuaacgucagu

SEQ ID NO: 7463 - RNA, 64 nt, Human
uaaugcuguacaauuuuaagugguagcaguuucuguaugcaguaggcugaaauauuuugaugaa

SEQ ID NO: 7464 - RNA, 64 nt, Human
uaauguguauuaaagggcuuacauggguauuagcuaaugcaguaguaugauuguuuuauuagca

SEQ ID NO: 7465 - RNA, 62 nt, Human
uaauguuuugggaaacacugaaaugaaaucuucccaguauuauaaauuguguauuuaaaaaa

SEQ ID NO: 7466 - RNA, 62 nt, Human
uaauuaacaucaaacacggcuucucaugcuauuucuaccucacuuugguuuugggguguucc

SEQ ID NO: 7467 - RNA, 62 nt, Human
uaauuaaguuuacauuuuaguuucuuugacaucuuguuuacaguuuuugucugauguuuuuu

SEQ ID NO: 7468 - RNA, 62 nt, Human
uaauuaauaggcuuuauuuguaagagcaguuuuauguuuacagaaaaauuaggcacaaaggg

SEQ ID NO: 7469 - RNA, 63 nt, Human
uaauuagauaugcaucuggcauuguuuuaucuuaucaguauuaucacucuuauguugguuuau

SEQ ID NO: 7470 - RNA, 62 nt, Human
uaauuauacuuaagaucuucaauuucuucaaaaaaugaaggaucaaaauuuuccaguucuuu

SEQ ID NO: 7471 - RNA, 62 nt, Human
uaauuauuuuuucuauguucacaucagcauucacuuccguuaaauuugccaaaggaaacugu

SEQ ID NO: 7472 - RNA, 62 nt, Human
uaauucagauguuuuacgcaaggaaggacuuacccaguauuacugcugcugugcuuuugauc

SEQ ID NO: 7473 - RNA, 62 nt, Human
uaauuccaugucaccaacaacacagacaagacccuguuuacaacuuuuucuuuccuuuuuuu

SEQ ID NO: 7474 - RNA, 64 nt, Human
uaauucggcaauggaauaucuuuuaaguuuuaaaaaaacuggaauaauuauaucuaucuuuuuu

SEQ ID NO: 7475 - RNA, 62 nt, Human
uaauugguauuuuuucccagcugacaugauuucucaguguuagaaaacaaacccuuagaacu

SEQ ID NO: 7476 - RNA, 62 nt, Human
uaauuggugacccaacccuaggaaguagggagaaaugaaggaagggcauaggaaaauuuucc

SEQ ID NO: 7477 - RNA, 62 nt, Human
uaauuguuaucuccuuuuggcuuaugugauuuucuguuuacaaguagaauagccaauuauuu

SEQ ID NO: 7478 - RNA, 63 nt, Human
uaauuguuuugggcugauuuuucaguaaauccaaagugacuuagguuagaaguuacacuaagg

SEQ ID NO: 7479 - RNA, 63 nt, Human
uaauuuauuuguaaaauccauaaaguacuucuguacaguauuagauucacaauugccauauau

SEQ ID NO: 7480 - RNA, 62 nt, Human
uaauuucauuaagaggaacaucaggcauugcaaucaguauuaaucaggggcucaaauacaga

SEQ ID NO: 7481 - RNA, 64 nt, Human
uaauuugugcguguguggacucacuauggaaauaaaaugcaguagaaagagcaugugccaggug

SEQ ID NO: 7482 - RNA, 64 nt, Human
uaauuuucaaaacaugauaaaugauuaagaauauaaaacuggaauuuagaacuuacagagaacu

SEQ ID NO: 7483 - RNA, 62 nt, Human
uaauuuugacuaaagaaauacuuuugaaguaugacaguauuaagucauaagauuuaaucuca

SEQ ID NO: 7484 - RNA, 61 nt, Human
uaauuuugccaaauaauaaaaacagaaggaaauugagauuagagggagguguuuaaagaga

SEQ ID NO: 7485 - RNA, 63 nt, Human
uaauuuuuaguagcaggucaaaaaccugcccuccugugacuuauucccugagacuuuucagga

SEQ ID NO: 7486 - RNA, 63 nt, Human
uaauuuuuauuccuuucaaaaucaugaaauaucucacacuggagagaugcuguaugauauaag

SEQ ID NO: 7487 - RNA, 63 nt, Human
uaauuuuugcugaugaaagugcuucauugacuaaacaguauuaguuuguggcuauaaaugauu

SEQ ID NO: 7488 - RNA, 64 nt, Human
uaauuuuuguguaugaacaaagcuguuguuuuuaccaugcaguauugcaugauuuuaaguuaug

SEQ ID NO: 7489 - RNA, 62 nt, Human
uaauuuuuuucacuaagcuguuugccuuccaaaguguuuacaccuuaagccuuaacauguau

SEQ ID NO: 7490 - RNA, 62 nt, Human
uacaaaaaaacgaaaaaaauaaggauugacugggcuaccucagcauacauuucugccacauu

SEQ ID NO: 7491 - RNA, 62 nt, Human
uacaaaaaaacuuuuaaaacuuugccauuucaucuguuuacacucuuugccacugauuagca

SEQ ID NO: 7492 - RNA, 62 nt, Human
uacaaaaacuauggaaaauaucuuuguucuuguuugcugcuauuuucuguccuauuuugaga

SEQ ID NO: 7493 - RNA, 64 nt, Human
uacaaaugugaaugaucgacugacugcuuguugccaaacuggaaauguucuguagggauuuacu

SEQ ID NO: 7494 - RNA, 62 nt, Human
uacaacuccacgaggugaaaaauauucaguaacuuguuuacauagcauuuguguaaagacua

SEQ ID NO: 7495 - RNA, 61 nt, Human
uacaagaaaaguuuuugggauauaauuugaaugacugugaaaacauaugaccuuugauaac

SEQ ID NO: 7496 - RNA, 63 nt, Human
uacaauaaaaaguauaaaaaagagaagauauuuaggugacuuacagcaaccaauugcaacaaa

SEQ ID NO: 7497 - RNA, 62 nt, Human
uacaauauuuauaacuauaaacuuuauagaaguacaguauuaaagucagugguacacagaca

SEQ ID NO: 7498 - RNA, 62 nt, Human
uacaauucaccuggaaugacucgcuccaauguuuuguuuacauccagauauggccaucugug

SEQ ID NO: 7499 - RNA, 62 nt, Human
uacaauuuaucuaaacugaauugagaaaaaauuacaguauuauuccucaaaauaacaucaau

SEQ ID NO: 7500 - RNA, 62 nt, Human
uacacauuuauuuuuucauuuagauacuuuccuucaguauuaugauugagacauuaaccuca

SEQ ID NO: 7501 - RNA, 64 nt, Human
uacagacaagagagccacaguagagaggcuuguuuaaugcaguaccauuggagaguuaacagaa

SEQ ID NO: 7502 - RNA, 61 nt, Human
uacagacccauaaaaaucccaucagugucguccccugcugagaggccaugugagaccauau

SEQ ID NO: 7503 - RNA, 61 nt, Human
uacagagaguggauuuucuccccaagucccaucccugcugaagaccgcuuggaugaacucc

SEQ ID NO: 7504 - RNA, 62 nt, Human
uacagccucaguagucugcccaguguccacauuaaugaaggauccauguuuguagugagaga

SEQ ID NO: 7505 - RNA, 62 nt, Human
uacagcuggguguuucucuuuucuaaagugaggccaguguuauuucccgggaguguucaguc

SEQ ID NO: 7506 - RNA, 64 nt, Human
uacaggaaguaugagaguucugaaacccuugauagaaacuggaagccugccauggaacacaaua

SEQ ID NO: 7507 - RNA, 62 nt, Human
uacaggcacucauugcuacugaaggggacaccaaugcugcuauccgcaagcucaagagaucc

SEQ ID NO: 7508 - RNA, 62 nt, Human
uacaggguggaagauggaugccugaaguguagacugcugcuagcugaauaccaucugggagc

SEQ ID NO: 7509 - RNA, 61 nt, Human
uacagguugguaggaauugcccaugucucuugcugagauuauggaucugugccacagggga

SEQ ID NO: 7510 - RNA, 62 nt, Human
uacauaauaaugccaucuaacuuauuuacguucuuguuuacaugugggagcuuuuguuuuca

SEQ ID NO: 7511 - RNA, 49 nt, Human
uacaucaccgccuugguaaaacaguauuauaaaaucaaaauauggguaa

SEQ ID NO: 7512 - RNA, 62 nt, Human
uacaucacuaaacaaagguuaacccuugugugaaaugaaggaacugucaauaauugacagcc

SEQ ID NO: 7513 - RNA, 62 nt, Human
uacauccuggguaaugagagguggcuuuugcggccaguauuagacuggaaguucauaccuaa

SEQ ID NO: 7514 - RNA, 62 nt, Human
uacaucuuuauuuaaauuuuuuuuuaacaucuuauguuuacaggcuuccuguuugaugaaga

SEQ ID NO: 7515 - RNA, 62 nt, Human
uacauguuuuccaacauauccuaaaaacugugauauaagcuaacauauaauuugccuuacgu

SEQ ID NO: 7516 - RNA, 63 nt, Human
uacauuaaguauuuauugagcuucugucauaugcccaguauuaugcuucuucuauacuguuuc

SEQ ID NO: 7517 - RNA, 63 nt, Human
uacauuauuagauuacuuuaauugagauuuguuaaaacgguuaggacuguuuuguccaggaaa

SEQ ID NO: 7518 - RNA, 64 nt, Human
uacauucuggucugcucagggagaagcuugccuuugaacuggaagauguugggaugagcaggga

SEQ ID NO: 7519 - RNA, 64 nt, Human
uacauuggcaugaauuuugugaauuaggguguuaaaaacuggaauugaauuuguacaaaaagag

SEQ ID NO: 7520 - RNA, 62 nt, Human
uacauugguguuuugauuggaauaaagaaauccuauaagcuauuugggaaaaauuauagugu

SEQ ID NO: 7521 - RNA, 62 nt, Human
uacauuuggguauaaugacaacagccaauuuauagugcaauaaaauguaauuaauucaaguc

SEQ ID NO: 7522 - RNA, 62 nt, Human
uacauuuuucugaaagcuacccauaaaaucacuuucaucucaccuaccugaugcaaagcagg

SEQ ID NO: 7523 - RNA, 63 nt, Human
uaccaaaagggucaauggaccuuucuuugcacugugugacuuaaucaacuauaaaagcuuaca

SEQ ID NO: 7524 - RNA, 64 nt, Human
uaccagcuuuuuuuuuuuuuuuuuuaaauuggcuuuggccaguagcuaaagugcaagacugaau

SEQ ID NO: 7525 - RNA, 63 nt, Human
uaccaggcccagcugggaccauaauuuguacagaaacacuggaugugauuaauagggaguagg

SEQ ID NO: 7526 - RNA, 64 nt, Human
uaccaggugucaucaaauuuuuuucuggaaagggccaugcaguaaauaguucaagcuuuguggg

SEQ ID NO: 7527 - RNA, 63 nt, Human
uaccaguuucacacccccuuuccaucuguuugauacaguauuauagauauaaauauauauaua

SEQ ID NO: 7528 - RNA, 62 nt, Human
uaccaucuuaaccauuuuuaagcauaugguacagcaguguuaacuccaugcauguugugaaa

SEQ ID NO: 7529 - RNA, 62 nt, Human
uaccaugucugaccugcaaaaaugcuggagaaaaaugaaggaaaaaauuauguuuuucaguu

SEQ ID NO: 7530 - RNA, 61 nt, Human
uaccauugugucauuggggggaccgucuuuaccccugcugaccucccaccuauccgcccug

SEQ ID NO: 7531 - RNA, 64 nt, Human
uacccaacuuaaaccaaaggcaugucuaucauguggaugcaguaacauuuacauuuaguuuuug

SEQ ID NO: 7532 - RNA, 62 nt, Human
uacccacaugguucucccacugcccugucugcucugcugcuacagaggggcagggccucccc

SEQ ID NO: 7533 - RNA, 61 nt, Human
uacccaggccccagcuggugccccagccuggugccugcugaagccaguccuggagcccaua

SEQ ID NO: 7534 - RNA, 62 nt, Human
uacccauuuguaaaaugggauuaauaauacuuaccuaccucacagggguguugugaggcucu

SEQ ID NO: 7535 - RNA, 62 nt, Human
uacccauuuucuuuaaucuucaauauuaauauuguguuuacauugaugagaacaagaguuaa

SEQ ID NO: 7536 - RNA, 63 nt, Human
uaccccaccuaacacauuugcacugccgggaauggacacuggaagugccaggaggaaggaagg

SEQ ID NO: 7537 - RNA, 61 nt, Human
uaccccugaguucaagcgauucuccugccucagccugcugaguaguugggauuacaggcgc

SEQ ID NO: 7538 - RNA, 61 nt, Human
uacccuauucuaucauuugcuguugcuugcugaacugugaagaacugcaugaacuauauuu

SEQ ID NO: 7539 - RNA, 62 nt, Human
uacccucagcccccugcacggccaggugggccuuuguuuacagccguaggcagcucucaaga

SEQ ID NO: 7540 - RNA, 61 nt, Human
uacccuccaugcuugcuguccugcucacaccuaccugcugaccacccauccuggcacagcc

SEQ ID NO: 7541 - RNA, 62 nt, Human
uaccgcaaggccuccuggauccaaagcaccaugucaguauuauuuguugguccuuuuugugc

SEQ ID NO: 7542 - RNA, 62 nt, Human
uaccgcucauugccucucuaauccugccugauuguguuuacagaagcuucugauuugcauug

SEQ ID NO: 7543 - RNA, 62 nt, Human
uaccucacacauccagaaggcucuggguuuuccaauaagcuaugguaacccuaaagaacaaa

SEQ ID NO: 7544 - RNA, 63 nt, Human
uaccugcugcagguucuguguaugaggccuucaugaacgguuaccuucuccauacacuaggga

SEQ ID NO: 7545 - RNA, 62 nt, Human
uaccuggaaauaauuuaccaaaauaacugaguguugcugcuaaagaacaaaaguggggaggu

SEQ ID NO: 7546 - RNA, 62 nt, Human
uaccuggaauaucauguauguuucauuuacuggauguuuacauuuuaggaaggaaaauaguu

SEQ ID NO: 7547 - RNA, 62 nt, Human
uaccuguaucaaaggaauuuuaacaaagagcaaucaguauuauuggaccaaauuugguguuu

SEQ ID NO: 7548 - RNA, 61 nt, Human
uaccuguuuuucuugucaaaccugagcacuccuccugcugaaguuucuuauuuaauuccag

SEQ ID NO: 7549 - RNA, 64 nt, Human
uaccuuccucacuguaucuuugcccagacccaccugggccaguaggccccuguccccagccaca

SEQ ID NO: 7550 - RNA, 64 nt, Human
uaccuuucuaagaccuccucccaagcacuucaaaggaacuggaaugauaauggaaacugucaag

SEQ ID NO: 7551 - RNA, 62 nt, Human
uaccuuuucagaaaccugcuuucauuugcuuagccaguauuagaacagaucuuuacaacagc

SEQ ID NO: 7552 - RNA, 62 nt, Human
uacgaauuguuucacaaacagaaaacauguaaagcaguauuaaaauuuggccaaacaagugu

SEQ ID NO: 7553 - RNA, 63 nt, Human
uacggaauuccuguccagaucuguuuauucuuuuacaguauuaaaugauuuucacuaauauau

SEQ ID NO: 7554 - RNA, 54 nt, Human
uacggggaaaggauccugaggcucacaugcaguagacuugggcaggcaaagggg

SEQ ID NO: 7555 - RNA, 63 nt, Human
uacguguaacaaaagucugcuuuuccagcaugagcacacuggagcccucugcucacuggcacu

SEQ ID NO: 7556 - RNA, 64 nt, Human
uacguuauuuuacuauuuguacuuuuauguaauaaaaugcaguacauuuuuaaauuuucuguca

SEQ ID NO: 7557 - RNA, 62 nt, Human
uacguuuauucucuucagcuuuaacuauacuugagugcaauaaaaaacuuaauaaaauuuua

SEQ ID NO: 7558 - RNA, 62 nt, Human
uacuaaguaugcagguuuccugguaccauugaguugcugcuauuaaagcucacacacgaaau

SEQ ID NO: 7559 - RNA, 62 nt, Human
uacuacggugaaagccgggugcuagagccccucuuguuuacaagacauaaugagggauuuga

SEQ ID NO: 7560 - RNA, 62 nt, Human
uacuauaauggaaucaagcaaauugacaaacuuuuguuuacaaaaaauaaaggcuuuauaac

SEQ ID NO: 7561 - RNA, 61 nt, Human
uacuauagaaaguacuuugugggaaccuuuauuacugugaaggagaaaaauagcuauuucu

SEQ ID NO: 7562 - RNA, 63 nt, Human
uacucaagaaaaaauauauggugguaucuuuuacaacacuggaacagaaauaaaguuucccuu

SEQ ID NO: 7563 - RNA, 62 nt, Human
uacucacucaauuguuacccuuuugcuguugucguguuuacaguuugcauuuugaaugauua

SEQ ID NO: 7564 - RNA, 62 nt, Human
uacucacugaaugcaugaaugaaugaaugaacaaaugaaggaaugacuaaggauguuuguag

SEQ ID NO: 7565 - RNA, 62 nt, Human
uacucaguaagacagugcagugcucaguaaggcagugcaauacucaguaacaguguaguacu

SEQ ID NO: 7566 - RNA, 62 nt, Human
uacucaugucgcuucuccuuguguuacccccucccaguauuaccauuugccccucaccugcc

SEQ ID NO: 7567 - RNA, 62 nt, Human
uacucguucuaucugaugagaacucacacuagcuuguuuacaagaugacgacaguccaaggg

SEQ ID NO: 7568 - RNA, 62 nt, Human
uacucucuguccccagauccucuuucuagcaugaaugaaggaugccaagaaugagaaaaagc

SEQ ID NO: 7569 - RNA, 63 nt, Human
uacucuugcagguuuccagauacaugaaagaacccacacuggagagaaaccuuaugaauguaa

SEQ ID NO: 7570 - RNA, 62 nt, Human
uacugagcuggguuccugcuccuucuugggcuccaugaaggaaguaagaggcuaguugagag

SEQ ID NO: 7571 - RNA, 62 nt, Human
uacugccaggcaugugggugugggugcauguggguguuuacacacaugccuacagguaugcg

SEQ ID NO: 7572 - RNA, 63 nt, Human
uacugcgccuucucuuucgaaaaacucuuaauuuagugacuuauggcaaaauuuuaucuuaaa

SEQ ID NO: 7573 - RNA, 62 nt, Human
uacuguaauugccagaggcagaaauggucuggguauaagcuauuucauaaaagcagcuuuaa

SEQ ID NO: 7574 - RNA, 62 nt, Human
uacugugacaagcaaggagggguugcuucccucccuaccucauccaucccacacaccuuggc

SEQ ID NO: 7575 - RNA, 61 nt, Human
uacuguuagaauaaagaggugacaccauaaaguccugcugauaaugagaguaguucaggac

SEQ ID NO: 7576 - RNA, 61 nt, Human
uacuucagccuuuaaugccuuuuauucauaaaaacugugaaagcuagacugaaccauugga

SEQ ID NO: 7577 - RNA, 62 nt, Human
uacuugaguugaugaauguguuauucauggugucucaucucaucaaugcaucuugagagacu

SEQ ID NO: 7578 - RNA, 62 nt, Human
uacuugauaccugggcauuuaacccccuacucugucaucucagaccccaggcaggaggccca

SEQ ID NO: 7579 - RNA, 64 nt, Human
uacuuguaaaauaaccccuucuagaaaauaagcauuaacuggaauguuucaaacaauuuugcuu

SEQ ID NO: 7580 - RNA, 63 nt, Human
uacuuguaugugcggagucacacugcagugccgaacaguauuagcucccguucccaagugugg

SEQ ID NO: 7581 - RNA, 62 nt, Human
uacuugucacaccugucuuaauaaacuggaguuuugcugcuaaagaacucuucucucugggg

SEQ ID NO: 7582 - RNA, 63 nt, Human
uacuugugcuguaccaaaaugguaauuauaacagacaguauuagaauuacugaauuaacaaug

SEQ ID NO: 7583 - RNA, 63 nt, Human
uacuuguuaggaaguagcuuaauuaccccccauugcaguauuauuguuauauauauaguuaau

SEQ ID NO: 7584 - RNA, 64 nt, Human
uacuuuuuauuauaucaauuauaauuucauuuuauuaacuggaauaagugcgaaaguguacauu

SEQ ID NO: 7585 - RNA, 62 nt, Human
uacuuuuuuuuacuuuuauaaugcauuuuacucccaguauuauguucauuuaauaaauuauu

SEQ ID NO: 7586 - RNA, 62 nt, Human
uagaaaaacuaguuuuuguuguaaaucuauccuugugcaauauacuguuuguucuagaaaug

SEQ ID NO: 7587 - RNA, 64 nt, Human
uagaaaauacuguuuucccauuguguguaguauuuaaugcaguaaauaauaaauuaauacugac

SEQ ID NO: 7588 - RNA, 61 nt, Human
uagaaaccuauuaguauugugaauguagauuuuacugugaagcuaucugugauuuagcugu

SEQ ID NO: 7589 - RNA, 62 nt, Human
uagaaacugaggguuaucuuugacacagaauugugugcaauauucuuaaauacuacugcucu

SEQ ID NO: 7590 - RNA, 64 nt, Human
uagaaaguaugauaauccgucagaaguaugauguaaaacuggaauccucuguauuuuuuaaaug

SEQ ID NO: 7591 - RNA, 64 nt, Human
uagaacgcuugagaggcacuuuguaaagauuuguuaaacuggaaacguuuuacaugaucugaua

SEQ ID NO: 7592 - RNA, 62 nt, Human
uagaagaaaaaaaacauaaacguggauagucaugucaucucaaaucccugacuuggcuuccc

SEQ ID NO: 7593 - RNA, 63 nt, Human
uagaagaacuuacaauguguucagguaguguuuauacacuggacuuguguaauuacuugugua

SEQ ID NO: 7594 - RNA, 62 nt, Human
uagaagcauaccauuuuccuuucauggaaggguacaguauuacaaagauaauuuguuuaacu

SEQ ID NO: 7595 - RNA, 61 nt, Human
uagaagccacuuaacuuccauacacuauaauaaacugugaacauauuuuuguuaccuaaug

SEQ ID NO: 7596 - RNA, 62 nt, Human
uagaagcugugugacugcuuuaauaacuuuuucccaguguuauuugaaucauacuacccguu

SEQ ID NO: 7597 - RNA, 62 nt, Human
uagaaggcaaagcugccaguaaaugucucagcauugcugcuaauuuugguccugcuaguuuc

SEQ ID NO: 7598 - RNA, 62 nt, Human
uagaagguuaauuuuuuccacuggcuuauccuuaaugaaggaaauccccugauaauuacuuu

SEQ ID NO: 7599 - RNA, 62 nt, Human
uagaauagccaguauuuauguuuuuuauaaaacugugcaauacgaauuaugcaaucacaaua

SEQ ID NO: 7600 - RNA, 62 nt, Human
uagaaugaaagaacauauuuuuagugauauguaaaugaaggauucuacaauagucauauauu

SEQ ID NO: 7601 - RNA, 64 nt, Human
uagaaugcuugagaggcacugaguaaagauuuguugaacuggaaauguuuuacaugauucuuaa

SEQ ID NO: 7602 - RNA, 62 nt, Human
uagaauguuaauguccuaguauuauuccgaacuacaguauuaacugcuuguugcuaguggau

SEQ ID NO: 7603 - RNA, 64 nt, Human
uagaauguuggaaaaagaugccaagucugucuugacaacuggaaacaggguuccacagcagccc

SEQ ID NO: 7604 - RNA, 62 nt, Human
uagaauguuuuauuauucaagucaaguucuagaguguuuacauacuauuauauaauguacag

SEQ ID NO: 7605 - RNA, 64 nt, Human
uagacacacaguucacugaaaauucagucagucaaaaacuggaagaacuguaaaagaaaaaagu

SEQ ID NO: 7606 - RNA, 64 nt, Human
uagacauaaggugcuuugauauaaaauauaaaauguaacuggaaaauagcucgagguccuucug

SEQ ID NO: 7607 - RNA, 62 nt, Human
uagaccaauauuaucgugaaauccaucuuauccaucaucucaucgguucaacaggcuccucg

SEQ ID NO: 7608 - RNA, 61 nt, Human
uagacugaucacucagaaauuaaaguccguuuuacugugaauauagcaauauaguacugga

SEQ ID NO: 7609 - RNA, 62 nt, Human
uagacuuuuuguuucuugcaacaacagugcccucugcugcuagaaaccuuuuucuacuuacu

SEQ ID NO: 7610 - RNA, 63 nt, Human
uagagaagaaaucaguaucugaguugcauaccaggcaguauuaaaaucuaacaggucuguuug

SEQ ID NO: 7611 - RNA, 61 nt, Human
uagagauauggcagcgaaaggauguaaacagugccugcugaaugauuuccaaagagaaaaa

SEQ ID NO: 7612 - RNA, 63 nt, Human
uagaggcaugggauguguuggaacgggauuuacacacacuggaggagcagggcaaguuggaau

SEQ ID NO: 7613 - RNA, 64 nt, Human
uagaguguuucgcaucagaauaacaugaguaagaugaacuggaacacaaaauuuucagcucuuu

SEQ ID NO: 7614 - RNA, 63 nt, Human
uagaguuugcagcugguaaaaccagaggcuacauccaguauuacugcuaagagacauucuuca

SEQ ID NO: 7615 - RNA, 61 nt, Human
uagauaaauuucaagacaggauacuacagguggccugcugaggcugccccauauuuuagaa

SEQ ID NO: 7616 - RNA, 62 nt, Human
uagauagcagcgaguccuucguuugaucaauaaacaguguuacagauaacuucaaguuuaua

SEQ ID NO: 7617 - RNA, 62 nt, Human
uagauauuugcccuuaguuuacugguuaaaaguuuguuuacagaacuuuucucuggugcuua

SEQ ID NO: 7618 - RNA, 62 nt, Human
uagaugaagagccaacuugaugaaugugcuauucauaagcuagaaacuacaguuuuuccaaa

SEQ ID NO: 7619 - RNA, 62 nt, Human
uagaugauucuuccggguccugagcaccugcuucaugaaggaagauagguagcccagagaag

SEQ ID NO: 7620 - RNA, 62 nt, Human
uagauguauuuaauauaauccuuacuuaaaauucuuccguuaccacccuugaaacaauuagc

SEQ ID NO: 7621 - RNA, 64 nt, Human
uagauuuuuauuaguagcuugaaagagcuuaaucauaugcaguaaguauuuuuauuaccaauaa

SEQ ID NO: 7622 - RNA, 62 nt, Human
uagcaaacugaugcugaggaugauugaggugggucuaccucaucucugaaaauucuggaagg

SEQ ID NO: 7623 - RNA, 64 nt, Human
uagcacccacuagauauuuuuaguacagaaaaacaaaacuggaaaacacauuguuuggucuugu

SEQ ID NO: 7624 - RNA, 62 nt, Human
uagcagcauaauuauuuccaaagaccccaguauuugcugcuauuuuuaaaacuccccugaug

SEQ ID NO: 7625 - RNA, 61 nt, Human
uagcaguaaaaauaguuaaaaauguggauagauacugugaagcugcucgcucagaaauaca

SEQ ID NO: 7626 - RNA, 61 nt, Human
uagcagugaaccuuaagucuggguacauguaacccugcugaggggcugugcaggccgcucc

SEQ ID NO: 7627 - RNA, 62 nt, Human
uagccaaaccauaucacuggugaugccacuucuucaguauuagggauucucagucagaagag

SEQ ID NO: 7628 - RNA, 64 nt, Human
uagccaacaguuguggcuacacagugagaucacaggaacuggaaauaggguuugucggcuuugg

SEQ ID NO: 7629 - RNA, 64 nt, Human
uagccaguauauuaaauauugauauaaaaauaaaagaacuggaaccagauucagaaucaugaaa

SEQ ID NO: 7630 - RNA, 62 nt, Human
uagccauaagaaaauaucugcuauacaggaaaaccaguauuaagcaaauaccaccauccuua

SEQ ID NO: 7631 - RNA, 62 nt, Human
uagccaucagauugaucuucuucacaccaagcucuguuuacauuccgagaggugucaugaag

SEQ ID NO: 7632 - RNA, 62 nt, Human
uagcccccuguucccucccccaacccuaucccuccuaccucacccgcagggggaaggaggga

SEQ ID NO: 7633 - RNA, 63 nt, Human
uagcccugguuccuuuuauggacaugaauagacucacacuggaaggaagcacuaugaaugcaa

SEQ ID NO: 7634 - RNA, 62 nt, Human
uagccuaggaaauuuaacauauauauaacuauagcaguauuaauaaugauaguuguacuucu

SEQ ID NO: 7635 - RNA, 61 nt, Human
uagccuugccacuuucuucagucacuuaaauggugagauuacacaucagugcaagaugacc

SEQ ID NO: 7636 - RNA, 62 nt, Human
uagccuuugagugucugucauggugcauccguuucaguauuauuuccuaaaaugagaagccc

SEQ ID NO: 7637 - RNA, 62 nt, Human
uagcggaugccuccucaggaauauucucgauuuaauaagcuaaaaaaaaaaaguucuguguu

SEQ ID NO: 7638 - RNA, 61 nt, Human
uagcuaauugggagaugauuuuuuuuggcuaauugagauuaccuuuagauuauguuuucaa

SEQ ID NO: 7639 - RNA, 62 nt, Human
uagcuccugccucccagaucgacucagcuuggauuguuuacaauaagcccaagcaugcugag

SEQ ID NO: 7640 - RNA, 61 nt, Human
uagcugaccugggauuuuaacuacuauuggggaacugugaauuuuuuaaacagacaaauca

SEQ ID NO: 7641 - RNA, 61 nt, Human
uagcuguguaaaauagcccggguuccacuggcuccugcugagguccccuuuccuucugggc

SEQ ID NO: 7642 - RNA, 61 nt, Human
uagcuuuguaacauuccucagugccuguccauaacugugaaguauuaagcacuuagggcca

SEQ ID NO: 7643 - RNA, 61 nt, Human
uaggaaauaagucucuuggcggucccugagaguccugcugaaauccagccaguguuuuuug

SEQ ID NO: 7644 - RNA, 62 nt, Human
uaggaaauuauggacuucaaaauuggacacuuccuguuuacaaaaagaaauucagagcuaaa

SEQ ID NO: 7645 - RNA, 61 nt, Human
uaggaauucucaaccugagugaacaauucaaacugagauuacuuguguuuagacucauaua

SEQ ID NO: 7646 - RNA, 62 nt, Human
uaggcacagaaaaaaauaggucagcuuaaaaauauguuuacauuggauaaaggauuaggcaa

SEQ ID NO: 7647 - RNA, 62 nt, Human
uaggcuuauuccauggaacaagaauuaaaaaugaauaagcuaucaauauauaauuuaaguac

SEQ ID NO: 7648 - RNA, 61 nt, Human
uaggcuuuuucauuuuuaagaaguuugucuagcugagauuagugguggauuuucucccacu

SEQ ID NO: 7649 - RNA, 62 nt, Human
uagggccuacaugguuauuugccugcucacuuuauguuuacaucucccacauucauaccaau

SEQ ID NO: 7650 - RNA, 62 nt, Human
uaggggaaucucuauuacucuguacuuauacuaauguuuacaagaaugcaauauacugugau

SEQ ID NO: 7651 - RNA, 62 nt, Human
uaggggucuggauuuuguagguccgacuacacagcaguguuaacucauuucucaugccauua

SEQ ID NO: 7652 - RNA, 63 nt, Human
uaggguacuuggcagguuaaauuaaaccagaagaggugacuuaauaaaaaagggaaugacauu

SEQ ID NO: 7653 - RNA, 61 nt, Human
uaggugcauacacagacccaggugaacacgcugacugugaaccugcccuguauccggagcu

SEQ ID NO: 7654 - RNA, 62 nt, Human
uaggugcccauugcaucuuuuugugcuauggaguuguuuacauuaagcaugaccgaacgaga

SEQ ID NO: 7655 - RNA, 62 nt, Human
uagguuggaggacaccgacuaauuugggaaacggaugaaggacugagaaggcccccgcuccc

SEQ ID NO: 7656 - RNA, 62 nt, Human
uagguuucaucuauccaccuggcuuucuccuuauuguuuacagauguaguucuuguuagagg

SEQ ID NO: 7657 - RNA, 61 nt, Human
uagguuugcgggggucugagucuauguucaaagacugugaacagcuugcugucacuucuuc

SEQ ID NO: 7658 - RNA, 62 nt, Human
uagguuugugacuuuccuaaaucaauucuauuacgugcaauacuucaauacuucauuuaaaa

SEQ ID NO: 7659 - RNA, 62 nt, Human
uagguuuucgcgucuggucuuagagcauguguauucaucucagcgugaauaccucagccagu

SEQ ID NO: 7660 - RNA, 62 nt, Human
uaguaaacggcagcuuaagauaaguaagcagagacaguguuaaggacgaguuggugucugug

SEQ ID NO: 7661 - RNA, 61 nt, Human
uaguaaauugaucauauuacauguacuaaggaaugagauuauaugcaguaaacccaacugg

SEQ ID NO: 7662 - RNA, 61 nt, Human
uaguaaucauguuggcuggucuggucacaggugacugugaaacagaugcccuggucuugcu

SEQ ID NO: 7663 - RNA, 62 nt, Human
uaguagcuguuuugaauaacauaggugcucuuccucaucucaucuccuacaccguggugagc

SEQ ID NO: 7664 - RNA, 62 nt, Human
uaguauuuccuucccuuuuaucuaauuuuuuauaugcugcuaaauauauuuuaaauauacua

SEQ ID NO: 7665 - RNA, 62 nt, Human
uagucauuaaaaacaguugccagugauaaucugcaugaaggaaaaagaacccugcaaauggc

SEQ ID NO: 7666 - RNA, 61 nt, Human
uagucccagccuuccuggugcuggggagggaggacugugaauggcuguucuccccucacug

SEQ ID NO: 7667 - RNA, 62 nt, Human
uagucuaugaaagaauaauuauaauaauguccaggugcaauacucuguaagucuauugguuc

SEQ ID NO: 7668 - RNA, 61 nt, Human
uagucucauuguaugaggugaaacauuuuguaaacugugaaucauuaugcaaauuuuccua

SEQ ID NO: 7669 - RNA, 62 nt, Human
uagucugcucuccccgggaaucucuaacaugcucuguuuacaucgauaaaugcacuuaagga

SEQ ID NO: 7670 - RNA, 63 nt, Human
uagugaaaacauuuagggacacccaaagaaugaugcaguauuaaaggggugguagaagcugcu

SEQ ID NO: 7671 - RNA, 64 nt, Human
uagugaagguucagaugcaaauggaaggaaaaaggaaacuggaaggaaaaccauugcgauuucg

SEQ ID NO: 7672 - RNA, 62 nt, Human
uagugacaggggccccaacuuagcaucccuucccuuccguuaggaaggagaugaccggaagc

SEQ ID NO: 7673 - RNA, 61 nt, Human
uagugacuacaguacaugagacaacaagguuacugagauuacaauucuucaaagguuaaug

SEQ ID NO: 7674 - RNA, 62 nt, Human
uagugauuaucauguacugcauuguuacuuuaaaauaagcuauuaaacuaguuuuuaugguu

SEQ ID NO: 7675 - RNA, 61 nt, Human
uagugauugaaagggaggguauuuauuauacaaacugugaacugcaaugacauccuuaguu

SEQ ID NO: 7676 - RNA, 62 nt, Human
uagugcgcuccagccugggcaacagagcgagacuucaucucagaaaauaaaaaauaggggcc

SEQ ID NO: 7677 - RNA, 64 nt, Human
uagugggcuauuaaacuuggauuuuucuuuuuauuaaugcaguauguucuuuuuauucaaguau

SEQ ID NO: 7678 - RNA, 63 nt, Human
uaguguccaaaugaguggggcuauaaauguaaaauacacuggauuuuaaagacaugguagaaa

SEQ ID NO: 7679 - RNA, 62 nt, Human
uagugucuuaccucacauaagccauuugcccacugugcaauauagaaagguguuuucaaaag

SEQ ID NO: 7680 - RNA, 61 nt, Human
uagugucuuggccuugaaagaaaagccugacuuccugcugacacaugugguaggggcaugg

SEQ ID NO: 7681 - RNA, 62 nt, Human
uagugugaauuaauccuuuugugcuguguuuaaucaguauuagcuuuauagaauuauauaug

SEQ ID NO: 7682 - RNA, 62 nt, Human
uaguguguuagcuggugggguacaauauaaccucucaucucaggcuauuuuaaaaaaacaau

SEQ ID NO: 7683 - RNA, 62 nt, Human
uaguguuccuucuaaauauuguaugcaguuuucccaguguuacgagauugguguugcuaucc

SEQ ID NO: 7684 - RNA, 62 nt, Human
uaguuacaucacauagggauuacuguaaaucaagucaucucaagucuagugaagacagccaa

SEQ ID NO: 7685 - RNA, 63 nt, Human
uaguuccaguuccuuuugguaccaugaaaggacucacacuggagagaaacccuaugaguguaa

SEQ ID NO: 7686 - RNA, 62 nt, Human
uaguucccacaucuggaaauaaggaugaucauagcuaccucacgguuacauugcaaagccuu

SEQ ID NO: 7687 - RNA, 62 nt, Human
uaguuguuccagaaaucuucauuuuaaauagaaguguuuacaaugccuuuuuucccccagua

SEQ ID NO: 7688 - RNA, 62 nt, Human
uaguuuaagaaaaaaaaauauuccuccccacugcaugaaggacuuggaugucauccaaacuu

SEQ ID NO: 7689 - RNA, 62 nt, Human
uaguuuuaauuuagcucgguucucuuguuggugccaguauuacauugaagacuaccuaugau

SEQ ID NO: 7690 - RNA, 62 nt, Human
uaguuuuagaaauaucaugaagcaaggaucuagucaguguuacaggguaaagguggaguuuu

SEQ ID NO: 7691 - RNA, 61 nt, Human
uaguuuucaucacugggacuuuaaaaaaaaauuacugugaaaaugagguauucuguacuuc

SEQ ID NO: 7692 - RNA, 62 nt, Human
uaguuuucuaaauguuucuuuuucuuuuuugagugugcaauauguaacaugucuaaaguuag

SEQ ID NO: 7693 - RNA, 61 nt, Human
uaguuuuuaaaaucagcacagaucuucuuaaaaacugugaacuauguuuugaaauacucgu

SEQ ID NO: 7694 - RNA, 64 nt, Human
uauaaaaaagaaaagacaacaaaauucaguugucaaaacuggaaauaugaccacagucagaagu

SEQ ID NO: 7695 - RNA, 62 nt, Human
uauaaaacaccgagcagauguaacucaaagaagacuaccucaagggauuuaauaaucacagu

SEQ ID NO: 7696 - RNA, 62 nt, Human
uauaaaagaaaccuuuguuguuuguugaaagaaaaugaaggaacagggggaaaaaaggugca

SEQ ID NO: 7697 - RNA, 62 nt, Human
uauaaaauauaaggauuacuuuuguauguuccaacaguauuauacuuguuuuggcaucagca

SEQ ID NO: 7698 - RNA, 61 nt, Human
uauaaaauguucaugagggacugaauacugaaaacugugaaauguacuaaauaaaauguac

SEQ ID NO: 7699 - RNA, 64 nt, Human
uauaaacuuguaaacuucaucuauuucaaauauuuuaugcaguacauuauauuauucuguacaa

SEQ ID NO: 7700 - RNA, 61 nt, Human
uauaaagaaagugcaaugucugaggaaauuucaacugugaaaacuacaacauauuuacuaa

SEQ ID NO: 7701 - RNA, 62 nt, Human
uauaaauauuuggucucuauuucauuuuuugcaucaguauuaauacuaaaauaugucucgcu

SEQ ID NO: 7702 - RNA, 62 nt, Human
uauaaauggcagcucuccuguuguauucagguguuguuuacagacuaacaaauguguuggca

SEQ ID NO: 7703 - RNA, 62 nt, Human
uauaaauuaugcagaguuauuuuccuauaucucacaguauuaaaaauaaauaauuaaaaauu

SEQ ID NO: 7704 - RNA, 62 nt, Human
uauaacucgaguuuauaggggaagaaaaagcuauuguuuacaauuauaucaccauuaaggca

SEQ ID NO: 7705 - RNA, 62 nt, Human
uauaagcuauuucauaaaagcagcuuuaaauugucaguauuaagguuuucauguggaaaggu

SEQ ID NO: 7706 - RNA, 62 nt, Human
uauaauaauuugccuuguguggucagcacuuaacuguuuacaaagcccuuucacgugcacag

SEQ ID NO: 7707 - RNA, 62 nt, Human
uauaaugcagcuaaccaaggacuccuguguuucuauaagcuaaugcuccagaaacuuugcca

SEQ ID NO: 7708 - RNA, 62 nt, Human
uauaauguuugaugccucucuucugcaaagcguaucaucucauugacugugaaucuguauau

SEQ ID NO: 7709 - RNA, 62 nt, Human
uauacaaaauggggauaaugauacuaaccauugccuaccucauagagauguuauggggacaa

SEQ ID NO: 7710 - RNA, 63 nt, Human
uauacacauggacacaccagaguguagaauaauagacacuggagacuuggaagaguuggaggg

SEQ ID NO: 7711 - RNA, 61 nt, Human
uauacacgugaaauuugaaaacuguacauucggugagauuaaauuuuauauacaacuguaa

SEQ ID NO: 7712 - RNA, 63 nt, Human
uauacagauguacuagcuaaagucucuuuaugugucaguauuaagaguaauauguagccagau

SEQ ID NO: 7713 - RNA, 64 nt, Human
uauacaguacaggaucuuuggucuacucuaucacaaggccaguaccacacucaugaagaaagaa

SEQ ID NO: 7714 - RNA, 62 nt, Human
uauacauuuuuccaauccccaugcaaacuguuccuguuuacauaccuucucuguuguaucag

SEQ ID NO: 7715 - RNA, 62 nt, Human
uauacuccccuaucuuguccuagcccaggccuccaugaaggagaaccugguggcauugcccc

SEQ ID NO: 7716 - RNA, 62 nt, Human
uauacucuccuuuugaaaagauaccauaaagcacauaagcuagaucacuacaaggagcuguu

SEQ ID NO: 7717 - RNA, 62 nt, Human
uauagacagacuuauuggacaauuauguuuuuugcaguguuaccagaaucaaggcucuguuu

SEQ ID NO: 7718 - RNA, 61 nt, Human
uauagcauacuucuuuuuuccaguuucaaucuaacugugaaagaacuucugauauuugugu

SEQ ID NO: 7719 - RNA, 62 nt, Human
uauagccaaugcuguuguagucguuuccucagccucaucucacugugcuguggucuguccuc

SEQ ID NO: 7720 - RNA, 62 nt, Human
uauagguaaauauagugauuuauaccaauaauuaauaagcuauuagguauagaaaaacauuu

SEQ ID NO: 7721 - RNA, 62 nt, Human
uauagucaucuguuaugcugugaaauuuggaauucaguauuaucauuuugaagucuguaaau

SEQ ID NO: 7722 - RNA, 61 nt, Human
uauaguuaaauauauuucuucacaauauuuuaaacugugaagaacuuuaucauacaggaaa

SEQ ID NO: 7723 - RNA, 64 nt, Human
uauauaaacauaaaacacacaaggaagguauuauguaugcaguaguauacuagaguuuaggaaa

SEQ ID NO: 7724 - RNA, 61 nt, Human
uauauaaauuggggugaugaccccauagaccuaacugugaacaaucagauuagacacuaug

SEQ ID NO: 7725 - RNA, 63 nt, Human
uauauaaugaacuuuguacuauucacauuuuguaucaguauuauguagcauaacaaaggucau

SEQ ID NO: 7726 - RNA, 62 nt, Human
uauauagcacuuuuauguucauauuuuuuuuuuaaugaaggaaacguucaauaagugaguca

SEQ ID NO: 7727 - RNA, 62 nt, Human
uauauauugcuuaggcucaccauagcgaauucuccaguguuaaaacuuuucuguuuucacau

SEQ ID NO: 7728 - RNA, 62 nt, Human
uauaucaguuuuuuuccccuucggucuuccacagcaguauuauugucuuuguggaguugacu

SEQ ID NO: 7729 - RNA, 61 nt, Human
uauaugaguugaaugcaauuuuuauuuuugguaacugugaaaaauaagauacuguggauau

SEQ ID NO: 7730 - RNA, 62 nt, Human
uauaugaugaaauguuauuuugccauuaaaauuuuguuuacaaagauaauuuuuauugacau

SEQ ID NO: 7731 - RNA, 61 nt, Human
uauaugcugugugcuuuuuagguguuuguuaguacugugaaggcaaaaaugcuuucuacau

SEQ ID NO: 7732 - RNA, 63 nt, Human
uauauggugauaguggcugcagccacuuuaccugugugacuuacccacagcaaugggauggua

SEQ ID NO: 7733 - RNA, 62 nt, Human
uauauguaaaguuauauuuucuuagaaacauggauguuuacagccauugcuuucaaagagau

SEQ ID NO: 7734 - RNA, 62 nt, Human
uauauguauuugagugcagaauuuaaauaaggcucuaccucaaagaccuuugcacaguuuau

SEQ ID NO: 7735 - RNA, 62 nt, Human
uauauuaagguucuccuugcccugaagcuucaggaugaaggacaggaagcugaaggagaaaa

SEQ ID NO: 7736 - RNA, 62 nt, Human
uauauugcaaaaacauaguuuguaaaggcauucuauaagcuauuuauguaaaaucaauaaaa

SEQ ID NO: 7737 - RNA, 62 nt, Human
uauauuuccauaguaucacauacuauuauuuaguuguuuacaagacuccaauuugaauucag

SEQ ID NO: 7738 - RNA, 64 nt, Human
uauauuuggggcaucucuauagaaagugaccaccaaggccaguaaguacgggaaaaaauguuua

SEQ ID NO: 7739 - RNA, 63 nt, Human
uaucaaggauuuucauguugaugacucgaaacugacaguauuaaggguaggauguugcuucug

SEQ ID NO: 7740 - RNA, 61 nt, Human
uaucaauauaauuugaagaagauuuuuaguaguacugugaaguucgugcuuaccuggauga

SEQ ID NO: 7741 - RNA, 62 nt, Human
uaucaaucaaaauguuuguaacuuaaaauuuuuaaugaaggauaaugaauauuuguagaguc

SEQ ID NO: 7742 - RNA, 62 nt, Human
uaucaaucacaacagguaauagcaauagacguuagugcaauacaaagucacccucaauaaau

SEQ ID NO: 7743 - RNA, 61 nt, Human
uaucaaugucauuuggcuauagaaacauuuucuccugcugauugugugugugaaacaugua

SEQ ID NO: 7744 - RNA, 63 nt, Human
uaucacucacacagaauuuuauuuuacauaguuuugugacuuaauuacacaugaauauaaaau

SEQ ID NO: 7745 - RNA, 63 nt, Human
uaucagugcuuugguacuuuugauuaccuguguuucaguauuagugucacuuuaguacuucag

SEQ ID NO: 7746 - RNA, 63 nt, Human
uaucaugaguggguauuuugauucuaugguucccucaguauuacaucuugacuuguaaucaau

SEQ ID NO: 7747 - RNA, 62 nt, Human
uauccaaagguggaaacaaaagaauguagagauccaguguuaagaguuccauuugcuucaau

SEQ ID NO: 7748 - RNA, 61 nt, Human
uauccauccugucacccugagcaucugucucaaccugcugaggcacagacuuccaccaugu

SEQ ID NO: 7749 - RNA, 64 nt, Human
uauccauguuguguagaccugugcauacaacaugcuaacuggaaaagaggaaaaaagaaaagcc

SEQ ID NO: 7750 - RNA, 62 nt, Human
uauccccacaauuuccggaaccuacauguauagcuguuuacaaaaucuccaaguuaauuaag

SEQ ID NO: 7751 - RNA, 62 nt, Human
uauccgcgagccugcuugcugauauugcaguuuuuguuuacaagaauaauuagcaauacuga

SEQ ID NO: 7752 - RNA, 64 nt, Human
uauccuugaguguuuacaacucaaacaacuuuuugaaugcaguaguuuuuuuuuuuuaaaaaca

SEQ ID NO: 7753 - RNA, 62 nt, Human
uaucuacauccuuaccugcauuggaaaauguuugcuaccucacaacaaccauuugccuccuu

SEQ ID NO: 7754 - RNA, 61 nt, Human
uaucuaccucacagacuuguuaugaggauaaagugagauuaaacugccucaaagugcuuug

SEQ ID NO: 7755 - RNA, 61 nt, Human
uaucuacuucuuuuaaaguuagaagaaaauuaaccugcugacaggcaacauuuuuggggug

SEQ ID NO: 7756 - RNA, 61 nt, Human
uaucuauagauuacagacauuguauggaaaagcacugugaauaucccuguccuguuccguu

SEQ ID NO: 7757 - RNA, 61 nt, Human
uaucucccagcaaugacccuacuacacucgcguacugugaauuugggaggagguaaaguug

SEQ ID NO: 7758 - RNA, 62 nt, Human
uaucuccugaaaagguuuaugaaaaagaagaaucucaucucagugaagaauacuucucauuu

SEQ ID NO: 7759 - RNA, 63 nt, Human
uaucucuuuuggucccauccucuaaagcagaggcaacacuggaacauggcuagccuuucuugu

SEQ ID NO: 7760 - RNA, 63 nt, Human
uaucugccaagaucguuugaauacaugcaaaacacacacuggagagaaaccuaugaauguaag

SEQ ID NO: 7761 - RNA, 61 nt, Human
uaucuggcuucaaauauuaugcaggggcaaacaccugcugauguggcaacugcugaugcuc

SEQ ID NO: 7762 - RNA, 62 nt, Human
uaucugucgcccugagcugauuuugaaagaugguauaagcuagggguuaguauaguuguuua

SEQ ID NO: 7763 - RNA, 61 nt, Human
uaucuguuucauauaaagagaugcugcauguucacugugaaguauugcugaauuaaauuga

SEQ ID NO: 7764 - RNA, 64 nt, Human
uaucuuuuguuuagaaagcaugcauguaauguauguaugcaguaugccuuacuuaaaaagauua

SEQ ID NO: 7765 - RNA, 62 nt, Human
uaugaaacauuuuuaagacaaaggcauuacuucucaguauuaccaaaccuaaacugguugaa

SEQ ID NO: 7766 - RNA, 63 nt, Human
uaugaaaguuaaagaauguacugugaugaaauguucaguauuauguugcuucucaguaucaug

SEQ ID NO: 7767 - RNA, 64 nt, Human
uaugaacuaacuguggugugugaaagagagaagaaaaacuggaaaucuuauuccguguguguuu

SEQ ID NO: 7768 - RNA, 62 nt, Human
uaugaauugcuguccuaacccuggcguuuuuauccaguguuaaaauaaauuauuucaaguuu

SEQ ID NO: 7769 - RNA, 63 nt, Human
uaugaauuuuuuuuuccugcuggguagauuguccagugacuuauggcaugaauuucuuuucau

SEQ ID NO: 7770 - RNA, 63 nt, Human
uaugacagugaagcagcacugugagugguucaagcacacuggaauauaaaacagucauggccu

SEQ ID NO: 7771 - RNA, 62 nt, Human
uaugagauacagaacuuggugacccauguauugcauaagcuaaagcaacacagacacuccua

SEQ ID NO: 7772 - RNA, 62 nt, Human
uaugaguagcuguguaugaauaaauauuaccugucuaccucaaaauacacauacugcugaag

SEQ ID NO: 7773 - RNA, 62 nt, Human
uaugaguguaagcaauguggaaaaaccuucagaucuaccucacaccuucgaaaacaugguag

SEQ ID NO: 7774 - RNA, 62 nt, Human
uaugauaacuuuuaaaaaagugucuguaaaucuucaguguuaaaaaaacagaugcccauuug

SEQ ID NO: 7775 - RNA, 62 nt, Human
uaugccaaauauauauugcuauaauacacucaagcaguauuaaucaauaugguaucacaaug

SEQ ID NO: 7776 - RNA, 62 nt, Human
uaugccuuggaaggccauggccugcacuuuaaaaauaagcuaaguccauucugcccagcacg

SEQ ID NO: 7777 - RNA, 62 nt, Human
uaugcucuuaaacaaaaguuugaaauuauccauaucaucucagugaaccuacugguggacuc

SEQ ID NO: 7778 - RNA, 64 nt, Human
uaugcugcugugguuagaagcagauuuuauacuuuuaacuggaaacuuugggguuugcauuuag

SEQ ID NO: 7779 - RNA, 62 nt, Human
uauggagacuuugcuguuacugcuucucuuugugcaguguuaguauucacccugggcaguga

SEQ ID NO: 7780 - RNA, 63 nt, Human
uauggcaaaacuaugcuuuugccaccuuccuguugcaguauuacuuugcuuuuaucuuuucuu

SEQ ID NO: 7781 - RNA, 62 nt, Human
uauggccccucuuaaccaugcugguguuaugauucaguauuaacucucaauuagcaugcccc

SEQ ID NO: 7782 - RNA, 63 nt, Human
uaugggacaaagcauuauggucuuuuuggguaagacaguauuagcaggauuuguaaaggguuu

SEQ ID NO: 7783 - RNA, 62 nt, Human
uaugggagagugucaaccagacagagggucacaguguuuacacuuuggaccuuacgaucagg

SEQ ID NO: 7784 - RNA, 64 nt, Human
uaugggcccuuuaaagacuacaagauuugcuagauaaacuggaaauggagaaguuauugcagac

SEQ ID NO: 7785 - RNA, 62 nt, Human
uauggggcuaggaugagagagaaugccacagaguaugaaggaagagugauagauccagauga

SEQ ID NO: 7786 - RNA, 62 nt, Human
uauguaaaauuucucaccauuuuggugggguaagauaagcuauuauuaagauuuaauccuua

SEQ ID NO: 7787 - RNA, 62 nt, Human
uauguaaaggucauagcagcaacugacaagaagugugcaauauuuaccuggauuaucuugau

SEQ ID NO: 7788 - RNA, 62 nt, Human
uauguaagguagggucuuuuuugcauauagacuccaguauuaguuacuuucauucuaaaauu

SEQ ID NO: 7789 - RNA, 62 nt, Human
uauguaauaaugacuccauccagcucuaucuuuguguuuacaucauggcaauggaaacacaa

SEQ ID NO: 7790 - RNA, 62 nt, Human
uauguacaaacaugagugggcacagaauuuuaaaucaucucaacuuuugagaaauuuugagu

SEQ ID NO: 7791 - RNA, 62 nt, Human
uauguauucuacaaaagagaaugguuuuaggcuccaguguuauacuuuuuuuuauauauaua

SEQ ID NO: 7792 - RNA, 64 nt, Human
uaugucagcagcaauacuuuaggauccacguggcagaacuggaaacaaugcuaccaucugauaa

SEQ ID NO: 7793 - RNA, 62 nt, Human
uaugucaguggacugcaacuguguaccugugcaauguuuacagauggaaagggugaggagau

SEQ ID NO: 7794 - RNA, 62 nt, Human
uaugugaaacacacauggacaugugucccagccacaguguuaugcucuguggcuggcucacc

SEQ ID NO: 7795 - RNA, 62 nt, Human
uaugugucagaacauucagaagaagucugaagaagugcaauauguuagauacucagcagaag

SEQ ID NO: 7796 - RNA, 63 nt, Human
uauguguccauaauuuaaaauucauguuauaguuucaguauuaaggcugacuuuuuuuuuuua

SEQ ID NO: 7797 - RNA, 62 nt, Human
uaugugugcagaggugguguggaugugagcgugcaugaaggaaaaaaagcugcuacuccuag

SEQ ID NO: 7798 - RNA, 62 nt, Human
uauguuacgaguaaaguuuggcugguagaauaaacuaccucaacuuaauuucauucuguuca

SEQ ID NO: 7799 - RNA, 62 nt, Human
uauguuaucuuccauucuauuuuuaucugcuuuuugcugcuaguuucaaacugccaguauuu

SEQ ID NO: 7800 - RNA, 62 nt, Human
uauguucaacucucauccaaauggcauaugacccuguuuacacagccuaaagcuaaaaauau

SEQ ID NO: 7801 - RNA, 62 nt, Human
uauguuuguuuuuugggggaaagaaacuggaacucaguguuaccuuaaaguuacggaauacu

SEQ ID NO: 7802 - RNA, 62 nt, Human
uauguuuuucuacuucacauugguuuucuuuuccuguuuacaucugcacuuguuuuuugcug

SEQ ID NO: 7803 - RNA, 62 nt, Human
uauuaaaauauccagugagcucuuuagaaggacucaguauuauuucaagacuauuuuugagg

SEQ ID NO: 7804 - RNA, 61 nt, Human
uauuaaacacaugaucuugguacuaacauacucacugugaacccagccuauugcaaaaaua

SEQ ID NO: 7805 - RNA, 61 nt, Human
uauuaaaggccugacucuuuccucucaucacugugagauuacagaucuauuugaauugaau

SEQ ID NO: 7806 - RNA, 62 nt, Human
uauuaacagcaacuaaaauuuuauauauuguaaccaguguuaaaagucuuaaaaaacaaugg

SEQ ID NO: 7807 - RNA, 62 nt, Human
uauuaagcagaaauuaccuuuucuuucucaaaaucaguguuauugcuuuagaguauaaacuc

SEQ ID NO: 7808 - RNA, 62 nt, Human
uauuaaguguacugcagagauaauacgacuucagcaguauuaauagcugauuacuuugcagu

SEQ ID NO: 7809 - RNA, 61 nt, Human
uauuaauauuccucacugaagugaguuuuguagacugugaacagcuguguucucauuuccu

SEQ ID NO: 7810 - RNA, 61 nt, Human
uauuaaugguaaaauguuggacuuggggauuacugagauuaguauguggguaguaaagaau

SEQ ID NO: 7811 - RNA, 62 nt, Human
uauuaauuugaaaauuauggggaaaauugcauuuuguuuacauguggugaacauguuucuag

SEQ ID NO: 7812 - RNA, 62 nt, Human
uauuacacguuccaguuugucucgcuguguaggcauaagcuaaugguuuauuuucagaaagc

SEQ ID NO: 7813 - RNA, 62 nt, Human
uauuaccagcuagccagucacuaggaauuuuuuucaguauuauuuguauguauuaaacuuuu

SEQ ID NO: 7814 - RNA, 63 nt, Human
uauuaggaaaauuaauuuguuaacucgucugugcacaguauuauuuacucugucuguaguucc

SEQ ID NO: 7815 - RNA, 62 nt, Human
uauuaggagcuguacauccaauucaaguuuuauuugcugcuauucugggagaauaaacuugu

SEQ ID NO: 7816 - RNA, 62 nt, Human
uauuagggaauaguuucagcucuuucaaagugcacaguguuacagucgaaugggcucccauc

SEQ ID NO: 7817 - RNA, 62 nt, Human
uauuauaauaaccucccaguucuaggggauauuugugcaauaaauacacaugucaacuugua

SEQ ID NO: 7818 - RNA, 62 nt, Human
uauuauacagaucuaaaacucgcaagugaaagauuguuuacaaacuuccugaauauuaucaa

SEQ ID NO: 7819 - RNA, 62 nt, Human
uauuauacuacucuaaauagcauauuucauccaagugcaauaauguaagcugaaucuuuuuu

SEQ ID NO: 7820 - RNA, 62 nt, Human
uauuaucucccugucuccauuaauaaauuuagcugugcaauauaggugcguuuuugcagaag

SEQ ID NO: 7821 - RNA, 61 nt, Human
uauuaugggauugcuaccuguauaaacaauggcacugugaaaauacuguuaguuuuaauac

SEQ ID NO: 7822 - RNA, 62 nt, Human
uauuauucuacuucucucuucuaugacaacucuagugcaauauuagaguuucauuuauucca

SEQ ID NO: 7823 - RNA, 62 nt, Human
uauucauguguacagaaacaacugccaaauaaaauguuuacauuuucuuucauacaccaaau

SEQ ID NO: 7824 - RNA, 62 nt, Human
uauucccaaugacugacagcuucucaucuugccucuaccucaguuaaguaaugucacccuga

SEQ ID NO: 7825 - RNA, 61 nt, Human
uauucccauccugccccuucucagaaccaguccccugcugaccucaaguucuccuccuuga

SEQ ID NO: 7826 - RNA, 62 nt, Human
uauuccccacccacacccccaggcaggguuggaaaugaaggacuuuuuuaaccuuuguuuug

SEQ ID NO: 7827 - RNA, 62 nt, Human
uauucuaaggaaccacaauaacuuacucuggccccaguguuaaaacgaucuuucagauuuag

SEQ ID NO: 7828 - RNA, 62 nt, Human
uauucuagaauagauacuguauuaaauauugccauguuuacaauauguaauauguuuuuagc

SEQ ID NO: 7829 - RNA, 63 nt, Human
uauucuaugccugcucuagaauugaaagacuucagcaguauuaaagcauuuuuuaaucuugga

SEQ ID NO: 7830 - RNA, 62 nt, Human
uauucuggaagcgugaauugcuuuugaagucugucaguauuacugguauuuuuaaauaaaga

SEQ ID NO: 7831 - RNA, 62 nt, Human
uauucuugguguuuagcuggcucgaugauguuaacaguauuaaaaauuaaaccccauaaacc

SEQ ID NO: 7832 - RNA, 64 nt, Human
uauugacaaaguauagaaacggggaaauggugacugaacuggaacuugcaucaucuaauuccau

SEQ ID NO: 7833 - RNA, 62 nt, Human
uauugacugaauuuucuucauuuucuguuuaguccaguguuaccaagguaagcuggggaaug

SEQ ID NO: 7834 - RNA, 63 nt, Human
uauugauuucacuuaccagcacauucucuacaauggugacuuagacaaaaguauaagauucau

SEQ ID NO: 7835 - RNA, 62 nt, Human
uauugauuucugaagcugguuuuaugaguugugacaguguuaccagguuggggguauguguu

SEQ ID NO: 7836 - RNA, 63 nt, Human
uauuggcagaaaagaccccauuuaaaacccagagaacacuggagggggaugcucuaguugguu

SEQ ID NO: 7837 - RNA, 61 nt, Human
uauugggagccauacuauuuuauaagcuuacuuccugcugacaaaacuagcuuuccucaag

SEQ ID NO: 7838 - RNA, 62 nt, Human
uauuguaauaggcauuuuuuuuuuuuuuuacaaugugcaauaacucagcaguuaaauagugg

SEQ ID NO: 7839 - RNA, 62 nt, Human
uauuguuuaauuugucagguuuuugacagaauuuuguuuacaaguaauaaaaauuuuaucuc

SEQ ID NO: 7840 - RNA, 63 nt, Human
uauuuaaaauuucguuguccaauuuguaaguaacacaguauuaugccugaguuauaaauauuu

SEQ ID NO: 7841 - RNA, 61 nt, Human
uauuuaaagcaccagucuggggucgccugggccccugcugacccccuccuccagagcagcc

SEQ ID NO: 7842 - RNA, 62 nt, Human
uauuuaacgaauaguguggaugugauuugucauccaguauuaaguucuuagucauugauuuu

SEQ ID NO: 7843 - RNA, 62 nt, Human
uauuuacuggcuuacacucaaaacgaccacaguccuaccucaguucaagguaaagccggauu

SEQ ID NO: 7844 - RNA, 62 nt, Human
uauuuagcccuuacucaaaaucagauaauuaacaaugaaggaaacucuaaacuccccuuaug

SEQ ID NO: 7845 - RNA, 62 nt, Human
uauuuauuuuuagggugauuuuuuaaaaagacuugugcaauacauuuugaggugaaacuuag

SEQ ID NO: 7846 - RNA, 62 nt, Human
uauuucauccagaauagaucaguuauugaagcagugcugcuaacauccauucccuuucauac

SEQ ID NO: 7847 - RNA, 63 nt, Human
uauuuccaguucccuuugauaucaugaauaaacuuacacuggacagaaacccuauaaauguaa

SEQ ID NO: 7848 - RNA, 62 nt, Human
uauuucuguuaucuagagguuagcagaaaaugaaaugaaggaauuucccuaagcaguuggga

SEQ ID NO: 7849 - RNA, 62 nt, Human
uauuucuuuaguuuaauuaaccuuuugguuguuugugcaauauuauauauuuuaaauuauaa

SEQ ID NO: 7850 - RNA, 62 nt, Human
uauuucuuuauuuucuucuccaguggucauugggcaguguuaaugcugaaacaucauuacag

SEQ ID NO: 7851 - RNA, 62 nt, Human
uauuugaaaucaggccuuucccggaaaaucaugcaugaaggaucauuauaaacaaacaauag

SEQ ID NO: 7852 - RNA, 64 nt, Human
uauuugacaguaauuaaaaucuuuuaaauguuauaaaugcaguauguuugugaaaguauuagaa

SEQ ID NO: 7853 - RNA, 64 nt, Human
uauuugaguauuuucaagaaaagaauaaaaacauuaaugcaguauuagguuaacuggauaucaa

SEQ ID NO: 7854 - RNA, 62 nt, Human
uauuuggccuuauuucugcaccaugaaauuaaaaucaucucauuccugaagaugaauguagg

SEQ ID NO: 7855 - RNA, 63 nt, Human
uauuuuaaaaacaaguugacuuuuucaguuucuugaacgguuaaggguggauuuaaaaacuag

SEQ ID NO: 7856 - RNA, 63 nt, Human
uauuuuaaaccuguugggccaaugagaaaagaaccacacuggagaucaugaugaacuuuuggc

SEQ ID NO: 7857 - RNA, 62 nt, Human
uauuuuacccugugacauuuaaauauacuuuugaauaagcuacuauccugaggcugaggguu

SEQ ID NO: 7858 - RNA, 61 nt, Human
uauuuucaguuucggauauuuuugacuuaaugaugagauuaucaagacguagcccuaugcu

SEQ ID NO: 7859 - RNA, 62 nt, Human
ugcuaaauuccucugccucagugcaagauaauuuuguuuacaacuauagcucacuuuuaugu

SEQ ID NO: 7860 - RNA, 62 nt, Human
ugcuacaaauagugcuaauaaaguuaaauugcacgugcaauacggaacacugucaauggacu

SEQ ID NO: 7861 - RNA, 63 nt, Human
ugcuacagcugaggccuggaucccggccuuucccugugacuuacgugucugucaccggcaggc

SEQ ID NO: 7862 - RNA, 62 nt, Human
ugcuacccucccaauucccccauuauggaguaaccaguauuauucagugagcuaugggguag

SEQ ID NO: 7863 - RNA, 62 nt, Human
ugcuagaaaucuugugccccauaugugcuucuuucaguauuauccuagauccucaggaguag

SEQ ID NO: 7864 - RNA, 59 nt, Human
ugcuaggauugcucucuagaacaagccagaagugacuuauuaaacuauugaaggaaaag

SEQ ID NO: 7865 - RNA, 61 nt, Human
ugcuauauuuuuguauauacaauaauauuugcaacugugaaaaacaaguugugccauacua

SEQ ID NO: 7866 - RNA, 62 nt, Human
ugcuauguguauaggaaagcagucucuguaucaauguuuacauguuacuacuuuuuaaauuu

SEQ ID NO: 7867 - RNA, 62 nt, Human
ugcucagccccgcggcuggaccuuccuucugcauuguuuacauugcauccuggaugggacgu

SEQ ID NO: 7868 - RNA, 62 nt, Human
ugcuccauuuuauuuuguugguguuucagaugggcaguguuauggcuacgugauauuugaag

SEQ ID NO: 7869 - RNA, 55 nt, Human
ugcuccgaagaucggcugaaagcuuccuguuuacacuuggagggaaaaguucuuu

SEQ ID NO: 7870 - RNA, 62 nt, Human
ugcuccuggguuuuaauuugggaggucaauuguucuaccucacugagagggaacagaaggau

SEQ ID NO: 7871 - RNA, 62 nt, Human
ugcucuuuuugggaugccugaugucucaucacggcaguauuaucucucugggaccucugaca

SEQ ID NO: 7872 - RNA, 62 nt, Human
ugcugacuuggauaauucauuauuaccagcaguuaugaaggaaauauugcuaaaaugaucug

SEQ ID NO: 7873 - RNA, 63 nt, Human
ugcugcaguggguaguucuaaggauggaaaggugacaguauuacucucgagaggcaauucagu

SEQ ID NO: 7874 - RNA, 63 nt, Human
ugcuggagaagagucagugagaccagcacucucaaacacuggaacuggacguucguacagucu

SEQ ID NO: 7875 - RNA, 62 nt, Human
ugcuggguuuagaccuuaugcuuuuuguccaguuucaucucaacacagcugccaugcuucag

SEQ ID NO: 7876 - RNA, 64 nt, Human
ugcuguaagaguuaaaauggacaaguauugauaucaaugcaguaugaacauuaggaaacaauga

SEQ ID NO: 7877 - RNA, 62 nt, Human
ugcuguaauguauauggcuuuacucaagcagaucucaucucaugacaggcagccacgucuca

SEQ ID NO: 7878 - RNA, 62 nt, Human
ugcuguacuuguagcuucucucuguuccucuguacaguauuaauagacaauaaacugccuuu

SEQ ID NO: 7879 - RNA, 62 nt, Human
ugcugucaucagaccuuuggcaaugggguggucacuaccucacaaggcaaaguguuguauga

SEQ ID NO: 7880 - RNA, 62 nt, Human
ugcugugacacccugaaaaagcugaccacaaaugcaguauuaucuugacauaccucuguccc

SEQ ID NO: 7881 - RNA, 62 nt, Human
ugcuuaggauucuguucccugggcugaaacugaaauaagcuaauuuuuugggucacgguggc

SEQ ID NO: 7882 - RNA, 62 nt, Human
ugcuuauacacucugauuccuauaauacagugcuauaagcuaugcacagaaaauaaaauguu

SEQ ID NO: 7883 - RNA, 64 nt, Human
ugcuucguggguacugaacacgaggguggaaaugaaaacuggaacuuccuuguaaauuuaaacu

SEQ ID NO: 7884 - RNA, 63 nt, Human
ugcuucucauuuuuuaaacuauguucuuuaaaucaacacuggaaacucuguauuauauacaag

SEQ ID NO: 7885 - RNA, 61 nt, Human
ugcuucucccaucguuagacaucugccaguaagccugcugagagaagccucagcccacuca

SEQ ID NO: 7886 - RNA, 61 nt, Human
ugcuugaccacucgcacauggcucuaggcuucuccugcugaguccuggucuuggccuguga

SEQ ID NO: 7887 - RNA, 63 nt, Human
ugcuugugggagacuuugcagggaggaggcagcagacacuggagaugacauucuuccacacga

SEQ ID NO: 7888 - RNA, 62 nt, Human
ugcuuuagcacaggacaacuuuacaaaacaugauuguuuacagcugcucuuccccucuuuuc

SEQ ID NO: 7889 - RNA, 62 nt, Human
ugcuuucaaagauaacuggguuagaggguggggugugcaauaggugauuuaucaugguuuuu

SEQ ID NO: 7890 - RNA, 62 nt, Human
ugcuuugucuucagagaauuuacccuuaaccaagcaguguuagacaagcauguucucucguc

SEQ ID NO: 7891 - RNA, 62 nt, Human
ugcuuuucuaacaaauucccgcguauuuugccuuugcugcuacuuuuucuaguuagauuuca

SEQ ID NO: 7892 - RNA, 64 nt, Human
uggaaaacaaaccauaagccugaggagguuuuuaucaacuggaaugcuuuauauuaguuuguuu

SEQ ID NO: 7893 - RNA, 61 nt, Human
uggaaaacauacaauucuguguuccucaguaaaugagauuagcgucuaaugaguagcaccc

SEQ ID NO: 7894 - RNA, 62 nt, Human
uggaaaagccugcuguuguuccacaucucguugcuguuuacauuccuuuguggagccuacau

SEQ ID NO: 7895 - RNA, 62 nt, Human
uggaaacucagcacauuugaacuuggguuugauucaguauuaacagaucuugacuacacuaa

SEQ ID NO: 7896 - RNA, 63 nt, Human
uggaaagaaauaccauauacauagauggaaaaacccaguauuauaaaaaccucaauucugaaa

SEQ ID NO: 7897 - RNA, 62 nt, Human
uggaaaguaccaaagaagcaggggaaucauuggccaguguuacguuuucacauugucugucu

SEQ ID NO: 7898 - RNA, 63 nt, Human
uggaaaguuuuugugagcuguguaaucccucuggucaguauuaugaaaucauuugucaguggu

SEQ ID NO: 7899 - RNA, 64 nt, Human
uggaaauaaucaaaugcaaaaagguaacaaauucauaacuggaaagcaaagagaagaacaagua

SEQ ID NO: 7900 - RNA, 63 nt, Human
uggaaauccauuagcuauaccuccaaacucauucaacacuggacaguucacagaguggacaau

SEQ ID NO: 7901 - RNA, 63 nt, Human
uggaaauccguuagccacaccuccagucucauucaacacuggacaguuuacaauguggacaau

SEQ ID NO: 7902 - RNA, 62 nt, Human
uggaacaauguucacaacaaaaugcaaguuaauaaugaaggaaaaauaaaaucagucaaauc

SEQ ID NO: 7903 - RNA, 63 nt, Human
uggaacacuuuccucuucuaugaccccucucuccccaguauuaucuuacuugcaaaauggaga

SEQ ID NO: 7904 - RNA, 62 nt, Human
uggaacauaagcaguguuaccccuggcugggagucaguauuauacaacaaauggugagcugg

SEQ ID NO: 7905 - RNA, 62 nt, Human
uggaacccucacugaaaguccagaaugucuaagccaguguuagauuuuguaaacaaguggaa

SEQ ID NO: 7906 - RNA, 61 nt, Human
uggaaccucaggacccgcccauuucucggcaguacugugaauuuugaaguuaaacuaaauu

SEQ ID NO: 7907 - RNA, 61 nt, Human
uggaagaaaaggcaauggcgggcuucagccagaccugcugagaccuagguugccacgguaa

SEQ ID NO: 7908 - RNA, 63 nt, Human
uggaagaaacgaauuuaaauaauuuccaacguaagacacuggaaauuuaagagaaggcuggaa

SEQ ID NO: 7909 - RNA, 62 nt, Human
uggaaguugaagaaggcaucaaacaaaacaaggauguuuacagacauaugcaaagggucagg

SEQ ID NO: 7910 - RNA, 63 nt, Human
uggaaguuuuaguuuacaaaacagagauuccuucaacacuggacacgucgagcauuuuguagc

SEQ ID NO: 7911 - RNA, 62 nt, Human
uggaauacuaguuuaucaugaaacaaugacuuaccuaccucacaggguuguugugaggauua

SEQ ID NO: 7912 - RNA, 63 nt, Human
uggaauaguuuaacagucaggaaggcuaaacuggucaguauuaauguguagcccuaccaaaaa

SEQ ID NO: 7913 - RNA, 62 nt, Human
uggaaucaccgacuacugaaucuccuacauguauugcugcuacuucaagcuccuccacuuga

SEQ ID NO: 7914 - RNA, 64 nt, Human
uggaauucagguacauuaagcuuuagugaagagugcaugcaguaauuccaaugugacugcauga

SEQ ID NO: 7915 - RNA, 64 nt, Human
uggaauuuacuucucuagcuuacaauggaccuuuugaacuggaaaacaccuugucugcauucac

SEQ ID NO: 7916 - RNA, 64 nt, Human
uggaauuuccuaggaauaucuucuacuaauucuuaaaacuggaaagccaugcccaugucaucgg

SEQ ID NO: 7917 - RNA, 62 nt, Human
uggacacaagagaucuggagagggaacugcuauuugcugcuacauucagauuaugagauguc

SEQ ID NO: 7918 - RNA, 62 nt, Human
uggaccaaguuuucauguaacuguugcagugaaagugcaauaucugaccccccugcucccag

SEQ ID NO: 7919 - RNA, 61 nt, Human
uggacggcagaggcaaggacggacgggagcuccacugugaaucggcggcacgcgccgcagg

SEQ ID NO: 7920 - RNA, 61 nt, Human
uggacugaauuugaaauuuuauauccacuccagugagauuaugauuuguagcuucauauau

SEQ ID NO: 7921 - RNA, 62 nt, Human
uggacuggcuguuccgaggggccgucuaccacuccuaccucaccaucuucgggcagaucccg

SEQ ID NO: 7922 - RNA, 61 nt, Human
uggacuucuugcagugaggaaauaaauguguucccugcugaacuucguaugcauauaaaga

SEQ ID NO: 7923 - RNA, 62 nt, Human
uggagaaaagcaccuggcuccagggccaguguuacaguguuacccuguaagguguuagccuu

SEQ ID NO: 7924 - RNA, 61 nt, Human
uggagagagcauguguucucugauugugaggucacugugaaugauuaaauugguaagggua

SEQ ID NO: 7925 - RNA, 62 nt, Human
uggagcaaauguccuaacagagaaauagaggugaugcugcuaaagggagaaaugccaggcgg

SEQ ID NO: 7926 - RNA, 62 nt, Human
uggagccuucuccccuccccaguuggacuaggggcaguguuaauuuugaaaagguguggguc

SEQ ID NO: 7927 - RNA, 61 nt, Human
uggagcgggcuggccccaugaggcgugauuuucacugugaaaugugcuucacguaacacug

SEQ ID NO: 7928 - RNA, 62 nt, Human
uggaggauauuccucggaaaaacagacuuugggaaugaaggagggacucaggaucauuguua

SEQ ID NO: 7929 - RNA, 64 nt, Human
uggagguucaacacuacguaccgcacuuuauaauuuaacuggaauugagaugaaggccagugac

SEQ ID NO: 7930 - RNA, 62 nt, Human
uggagucugcuguugucagaaggcagggagggugaugaaggacugacccacauggacuggga

SEQ ID NO: 7931 - RNA, 62 nt, Human
uggaguuaauggucacuagauuaucaguuaugagcaguguuaaaaucuccuauuaaugugua

SEQ ID NO: 7932 - RNA, 64 nt, Human
uggauaaccgguaaugggaaaaugcuccgacccucaaugcaguaaauauuuacuugcaggcaac

SEQ ID NO: 7933 - RNA, 61 nt, Human
uggaucaauauuaguaaccccauccaagauugaacugugaaagagagguuccagggguauc

SEQ ID NO: 7934 - RNA, 63 nt, Human
uggaucaguggaccugcugaagucacuggacucaugugacuuagguuugcagcaucagacccc

SEQ ID NO: 7935 - RNA, 62 nt, Human
uggaucguuucuacuucuugacuauuauacauaaugcugcuaggaacuuuuguguaugaguu

SEQ ID NO: 7936 - RNA, 61 nt, Human
uggaugcuggguggucuguguacuuaaccugaaacugugaaguuuucccuuuuugccagua

SEQ ID NO: 7937 - RNA, 64 nt, Human
uggauguuuaauucuucauuaauaaauaccucaaauggccaguaaccuucauuaauaaauaccu

SEQ ID NO: 7938 - RNA, 62 nt, Human
uggauuaauguggguuuuucuguucauuuuauugcaguauuaaaugcuuaagcuuauuagga

SEQ ID NO: 7939 - RNA, 62 nt, Human
uggauuagggugggaucuuugaaaagcugacauuugcugcuaucauuccaacacuaaauucu

SEQ ID NO: 7940 - RNA, 62 nt, Human
uggauucaggacccuccaugacuggccuauuuacuguuuacagcuggccagugcagagcugc

SEQ ID NO: 7941 - RNA, 61 nt, Human
uggauuuaccccuggacccauaagucuguucauccugcugaaguccccuccccauugcucc

SEQ ID NO: 7942 - RNA, 62 nt, Human
uggauuuauucugccaaaccuguguaggcauuuuauaagcuacauguucuaauuuuuaccga

SEQ ID NO: 7943 - RNA, 62 nt, Human
uggauuuuguauuaaaauauauagaagcaauuucuguuuacauguccuugcuacuuuuaaaa

SEQ ID NO: 7944 - RNA, 63 nt, Human
uggcaacauuugcccccagaauugggggccugggaacacuggaccugcuccuucuccccucuc

SEQ ID NO: 7945 - RNA, 62 nt, Human
uggcacucgauaccucuggcaagaggaugauuaucuaccucacugauaagaggcaucgcaug

SEQ ID NO: 7946 - RNA, 64 nt, Human
uggcacugggcccauuugaaggugucucagacauuuggccaguaugucuuucucagggguuugg

SEQ ID NO: 7947 - RNA, 62 nt, Human
uggcacugucuuugaugcagugauguacuuaauggugcaauaaagcugcuucgauuuggugg

SEQ ID NO: 7948 - RNA, 62 nt, Human
uggcagcuuugggugagcuuagauuuuucaccuucaguguuacauuguguuugcuuuuaaaa

SEQ ID NO: 7949 - RNA, 61 nt, Human
uggcaggcuaggacacacagugaacauuaauguacugugaaucguuccugauaagugaaua

SEQ ID NO: 7950 - RNA, 64 nt, Human
uggcauaguuucauggaaaggaguacguuguaguuuaugcaguaucugacugcaaaucauauuc

SEQ ID NO: 7951 - RNA, 64 nt, Human
uggcaucaauagggggacagaggcugaugcuggaguggccaguagaggugguggagcagagcag

SEQ ID NO: 7952 - RNA, 61 nt, Human
uggcauggcagauuccuggcagcugcccagaacccugcugaugagccugcuccaugggacc

SEQ ID NO: 7953 - RNA, 63 nt, Human
uggcauggugcccucagccuuugcauauacucucucaguauuaacucccaguaaauaauaacc

SEQ ID NO: 7954 - RNA, 64 nt, Human
uggccaccucgcagcuguucgcccccucaaccuuugaacuggaacugcuggcucacacaggguu

SEQ ID NO: 7955 - RNA, 61 nt, Human
uggccagcucacgccugcuuccucccucccugcccugcugaauccuaaagcugugccuaua

SEQ ID NO: 7956 - RNA, 63 nt, Human
uggccccucuggccagggccccuguggcuuccugcacacuggacaggugacuguaugguagag

SEQ ID NO: 7957 - RNA, 62 nt, Human
uggcccucagcucccugacccccuguccuaggucaugaaggacacucugcagggugaagcac

SEQ ID NO: 7958 - RNA, 62 nt, Human
uggcccugggugaguuacuugccuucccugaggcucaucucagcacauauaauagaaaaugg

SEQ ID NO: 7959 - RNA, 64 nt, Human
uggccggauguccucagggcuggcagaugcaguagacugcaguggacaguccccaccuuguuac

SEQ ID NO: 7960 - RNA, 63 nt, Human
uggccugaggcucagacccagacguggugcuucucacacuggaggagcacacauccaagaggg

SEQ ID NO: 7961 - RNA, 62 nt, Human
uggccugucaaucagucuuaaccgcuuuauaguccuaccucaaacauaaugauaaaucuuua

SEQ ID NO: 7962 - RNA, 63 nt, Human
uggccugugauugcgcaaacccacauuuccuaagcacacuggacacccuucgaguguggguuu

SEQ ID NO: 7963 - RNA, 61 nt, Human
uggccuuccgcaguguuugugucccuggguacuugagauuagggaguggugaugauucuua

SEQ ID NO: 7964 - RNA, 62 nt, Human
uggccuuguccacuccuugaggcagauccuggcacuaccucacagcucccuggggacggcca

SEQ ID NO: 7965 - RNA, 62 nt, Human
uggcgcaucagauagucucuguguaccuggauuugugcaauauguaaaaauguaucaaaugu

SEQ ID NO: 7966 - RNA, 64 nt, Human
uggcuaauaggauaauaaaaugcuguguaaauguuaaacuggaaguuucucugaguuauuuuua

SEQ ID NO: 7967 - RNA, 62 nt, Human
uggcuacugguguauguagcaguucuuaaaucagcaguauuaugaaaaaaaauucccccuca

SEQ ID NO: 7968 - RNA, 64 nt, Human
uggcuagauaaauguggugaaauugccacuagaaagggccaguagcaauguguucuuaauuccu

SEQ ID NO: 7969 - RNA, 62 nt, Human
uggcuauuccucuugcaaaugaacccuuaaaguacaguguuauuuaagaaucuuccagaggc

SEQ ID NO: 7970 - RNA, 61 nt, Human
uggcuccagcuggccgggagccugaucaccugcccugcugagucccaggcugagccucagu

SEQ ID NO: 7971 - RNA, 61 nt, Human
uggcugagaccugggauuugagauaccacaaacccugcugaacacagugucuguucagcaa

SEQ ID NO: 7972 - RNA, 63 nt, Human
uggcugaucuggcguccacaccccagguguugcugacacuggaugacgaccuggauacuuaga

SEQ ID NO: 7973 - RNA, 62 nt, Human
uggcuggacuaccgagagcuuggacuacacaauacaguauuauagacaaaagaauaagacaa

SEQ ID NO: 7974 - RNA, 61 nt, Human
uggcuggccugguaagggggucccugugcugauccugcugaccucacuguccugugaagua

SEQ ID NO: 7975 - RNA, 63 nt, Human
uggcugugccugugacuccagaguccuaucuuacugugacuuaaaguuugauggagagaaagc

SEQ ID NO: 7976 - RNA, 63 nt, Human
uggcuguuggcugucaucuugaacucuauuugaaugugacuuaaaucacaaguaacguguuuu

SEQ ID NO: 7977 - RNA, 64 nt, Human
uggcuuccguugguguuuggaacauaguagguuuuuaacuggaauauaauagcuaccauuauca

SEQ ID NO: 7978 - RNA, 61 nt, Human
uggcuucucuccucagacuucuauuuuuuaaagacugugaaauguuugucuuuucuguuuu

SEQ ID NO: 7979 - RNA, 62 nt, Human
uggcuugacagcaucuuccugguuguauguggccuguuuacaugauguauugaauaauguug

SEQ ID NO: 7980 - RNA, 64 nt, Human
uggcuuggaccuuggcauuccguuugaauuccuucuaacuggaacauuuguguuguaucuguaa

SEQ ID NO: 7981 - RNA, 61 nt, Human
uggcuuuucuaaucaucucugauuguuagaaacacugugaaacuuuuauccaucaguccug

SEQ ID NO: 7982 - RNA, 64 nt, Human
ugggaaaaauaggcugcaggucuccagagcauaucgaugcaguacuguacuagagcuguuguga

SEQ ID NO: 7983 - RNA, 62 nt, Human
ugggaaaguuauuuuuaauuauauauuuguauagucaucucacuguuguuaauuuucaauag

SEQ ID NO: 7984 - RNA, 61 nt, Human
ugggaaccucacuguucucucuuucagccuagaccugcugauccagggugugugugaguug

SEQ ID NO: 7985 - RNA, 63 nt, Human
ugggaccauuguuuauaaauuuauugcuaaucuuacaguauuaggauucauuauaaaaaccaa

SEQ ID NO: 7986 - RNA, 61 nt, Human
ugggagaaacaguaacaaaagauuuuaauacuaugagauuaacugacuuaguugugguaug

SEQ ID NO: 7987 - RNA, 64 nt, Human
ugggagaacuaaguaagaaacacaaugccaacagcuggccaguaauuaguguugugcacuucau

SEQ ID NO: 7988 - RNA, 62 nt, Human
ugggagguauaacccugcuccucucucccagucugugcaauaaaggucgugaagaucucucu

SEQ ID NO: 7989 - RNA, 64 nt, Human
ugggaugaaauacuuaaugaucuuuccauuggaaauaacuggaagugaagagguuuuguugcuu

SEQ ID NO: 7990 - RNA, 61 nt, Human
ugggcaauucacuuaacuucuccauggcugcuuccugcugaauaaauagggacaggcauaa

SEQ ID NO: 7991 - RNA, 63 nt, Human
ugggcaccuccuugaagaagcugauagcuuuuacacaguauuagauugaaauaauggacagaa

SEQ ID NO: 7992 - RNA, 62 nt, Human
ugggcagaugaaaaugaugcauggccaaguucaguguuuacagauaaaacugcugugguuca

SEQ ID NO: 7993 - RNA, 62 nt, Human
ugggcaguuguacucaugggggcuuaggaugcagcuaccucagugcgcagggcccgucuguc

SEQ ID NO: 7994 - RNA, 61 nt, Human
ugggcaucuucugcccaugggcuccauuuggcaccugcugagccacaguuguccugcugga

SEQ ID NO: 7995 - RNA, 62 nt, Human
ugggccaccagagaacccuuauugauuacuuaaguguuuacauuauuuuaaagacuccuguu

SEQ ID NO: 7996 - RNA, 62 nt, Human
ugggcccagggccuagggcccaggaucaagucacucaucucagaauguccccaccaaucccc

SEQ ID NO: 7997 - RNA, 63 nt, Human
ugggccggggagucccugucucucacagcaucuagcaguauuauuaaauggauucauuuuaaa

SEQ ID NO: 7998 - RNA, 61 nt, Human
ugggccuugggugugucucaugggggaaaaaaaacugugaaaaaccucagaguagcaucuu

SEQ ID NO: 7999 - RNA, 62 nt, Human
ugggcuggaguagaggacucuggugggaagguuuugcugcuaauguauuuauggaaugaaug

SEQ ID NO: 8000 - RNA, 61 nt, Human
ugggcuguacuuacugugauacugaaaagcuguccugcugaagcagcuauauuugaaauau

SEQ ID NO: 8001 - RNA, 62 nt, Human
uggggaacccuucacccuucugugagauuuuccaucaucucaaguucucuucuauccaggag

SEQ ID NO: 8002 - RNA, 63 nt, Human
uggggacccagugggaccaggugcgggggcagagggugacuuaccaagagccagggagggcag

SEQ ID NO: 8003 - RNA, 63 nt, Human
uggggacgcccccgccucccugucccccguuucacacacuggacaccaucaccucuuuggaac

SEQ ID NO: 8004 - RNA, 61 nt, Human
uggggagcaaagagggcagccugacuagaugccccugcugaaucugguacuuucugcacag

SEQ ID NO: 8005 - RNA, 62 nt, Human
uggggauuguggucacaugaagcucuuucugcaucaguauuaagguguauauuugaaugucc

SEQ ID NO: 8006 - RNA, 62 nt, Human
uggggccaauacggaaacccuaccccuuccaugcucaucucacugcccagugaagggggcaa

SEQ ID NO: 8007 - RNA, 62 nt, Human
uggggcuugcgcugggccguggugggaggcacaguguuuacaggcucugguggcagagcagu

SEQ ID NO: 8008 - RNA, 61 nt, Human
ugggggccugaagaggauaagguagagcucccaccugcugaacuggugcagagggacgugg

SEQ ID NO: 8009 - RNA, 64 nt, Human
ugggggcgggcucaggagaguccauagaucagccguaacuggaacguagaaucuacgucugccu

SEQ ID NO: 8010 - RNA, 62 nt, Human
ugggggcugcuguuagcuucuccgucaggaggccucaucucacuguagcccuggaacccagg

SEQ ID NO: 8011 - RNA, 62 nt, Human
uggggguaucuuuccccuuuccugcccuuucugcucaucucaaccucucacagaggugucuu

SEQ ID NO: 8012 - RNA, 62 nt, Human
uggguaaaugauuuuuuuccccaaaaaugugagaaugaaggaagauugaguuucauucaagu

SEQ ID NO: 8013 - RNA, 61 nt, Human
ugggucauaaugagguagcuaaacaguugugccacugugaaugucuuuccuaguccuuggg

SEQ ID NO: 8014 - RNA, 63 nt, Human
uggguccuuggaaacaguucuggcacacaggcagaacacuggaggccaccucaaaggacagag

SEQ ID NO: 8015 - RNA, 64 nt, Human
uggguccuuuaucuugcacguagauuaaguugguggaacuggaauaauccuuuugauuuguggc

SEQ ID NO: 8016 - RNA, 63 nt, Human
ugggucucuacaagugacagauguguuguuuucaacaguauuauuagguuaugaauaaagccu

SEQ ID NO: 8017 - RNA, 62 nt, Human
ugggucuggaccccacggggcuggggagggccaugugcaauauuuggaggguuuucuggagg

SEQ ID NO: 8018 - RNA, 61 nt, Human
ugggugaucuggggaucacgccuugcccaagugugagauuaccuuucuguuccuugcaguu

SEQ ID NO: 8019 - RNA, 62 nt, Human
ugggugcauauacguagagucugaacaggugcucugcugcuagaaacagcaaaccaucuaga

SEQ ID NO: 8020 - RNA, 62 nt, Human
ugggugucccugguagggaagugccuguguggucuguuuacagugcagaaggcggcucagca

SEQ ID NO: 8021 - RNA, 64 nt, Human
uggguucaagcaauucucugccucagccuccugaguaacuggaauugcaggucagagcagagca

SEQ ID NO: 8022 - RNA, 62 nt, Human
uggguuggggcuccccaaggugugcccagcagaagugcaauagccaggaggguugccccucc

SEQ ID NO: 8023 - RNA, 64 nt, Human
uggguugguuucuuuccuuuaaaaaaauuuguauaaaacuggaagugugugugugugagcaugg

SEQ ID NO: 8024 - RNA, 62 nt, Human
uggguuguuucugacuuuuggcuauugggaauagugcugcuaugaauguuuguguaccugua

SEQ ID NO: 8025 - RNA, 63 nt, Human
uggguuuauauugauguguaacaaguugauuuggaacacuggacucucauucuguuauucugg

SEQ ID NO: 8026 - RNA, 64 nt, Human
uggguuuggucuacccacccaagagaaaagacuguuaacuggaagaaaaaauauauauauaaaa

SEQ ID NO: 8027 - RNA, 62 nt, Human
ugguaaagccccuccucuuggcaccucagaaucacaguguuacugaucagggaugugaggcu

SEQ ID NO: 8028 - RNA, 61 nt, Human
ugguaaaugcuauaauuauguaaugaucaggauugagauuaauacuguaguauaaauuggg

SEQ ID NO: 8029 - RNA, 62 nt, Human
ugguaagaaugaccugucacuauaauauacuguauguuuacauuuuauuuaaauuuaaucuc

SEQ ID NO: 8030 - RNA, 62 nt, Human
ugguaauagcaaaugaccuccuuuaacaagacacucaucucaaacaaugccauuuaguucag

SEQ ID NO: 8031 - RNA, 61 nt, Human
ugguaauaggaggugggacugagcucugaugaaugagauuagugcccuuauaaauuaugac

SEQ ID NO: 8032 - RNA, 62 nt, Human
ugguaccaggaaagaggauauucuaggcuuugcgugcugcuagcuggguucaggcuucaccc

SEQ ID NO: 8033 - RNA, 61 nt, Human
ugguacugugcaucuauucauaaaacacucaaaacugugaaaauaugguuuacauuuaauu

SEQ ID NO: 8034 - RNA, 62 nt, Human
ugguagaaaugaugucagcauucuuauuugcugaugcugcuaugauaccacgccuuaaaaau

SEQ ID NO: 8035 - RNA, 62 nt, Human
ugguagaaaugguuuuuaguuauugacucagaauucaucucaggaugaaucuuuuaugucuu

SEQ ID NO: 8036 - RNA, 63 nt, Human
ugguagcgcugucuccuggugaaggaguauuugucacacuggaaugugacuguguguguaugu

SEQ ID NO: 8037 - RNA, 61 nt, Human
ugguaggauugcugacucuguccaacagauaucacugugaauugaauaaauuuguugaaag

SEQ ID NO: 8038 - RNA, 61 nt, Human
ugguaggugauauuguuagugaugugagugaugccugcugaaguacugagagaugaagcau

SEQ ID NO: 8039 - RNA, 62 nt, Human
ugguauacuuggauuaaaauauuucauccagauuuguuuacaucuagagagaaccccuugua

SEQ ID NO: 8040 - RNA, 62 nt, Human
ugguauaugguuaauguguaaaacaagguucuaacaguauuacugaauauuaauguuucuug

SEQ ID NO: 8041 - RNA, 62 nt, Human
ugguaucuaaugaauguguagacagggagauaaaaugaaggauugccagacuaguuagaaua

SEQ ID NO: 8042 - RNA, 62 nt, Human
ugguaugaacagaucugauuucuuacagagaggcaugaaggaauaggcaggacuuaacuugg

SEQ ID NO: 8043 - RNA, 62 nt, Human
ugguaugugccauuggguuggauguccccacuacuuccguuaacccuucccauugucaagau

SEQ ID NO: 8044 - RNA, 61 nt, Human
uggucacugaaugggaauucucuuaagaaacccugagauuaaaaaaagacuauuuggauaa

SEQ ID NO: 8045 - RNA, 62 nt, Human
uggucauuugucaaagggggaaggcacccacugccuaccucacagggcuguugugaggauca

SEQ ID NO: 8046 - RNA, 63 nt, Human
uggucccagaacaggcagucucacaagcacgcagcacacuggaguggacgccugugcccaccc

SEQ ID NO: 8047 - RNA, 62 nt, Human
ugguccugguuucaacauggaagugagauagcugaugaaggauuucaagucuggaaauggga

SEQ ID NO: 8048 - RNA, 61 nt, Human
uggucguccuuugagugacaacuucuccgugaaccugcugaagaggcagaaaggcugugga

SEQ ID NO: 8049 - RNA, 61 nt, Human
uggucucgcacugccacugcauggccuccugucacugugaaucguggcccagucucaguuu

SEQ ID NO: 8050 - RNA, 62 nt, Human
uggugaauuuaaagcuuaaaauaugggaaugauuugcugcuauauuuccuuugagagagaaa

SEQ ID NO: 8051 - RNA, 63 nt, Human
uggugaggugaaaguaucacuggacuaggaagaaggugacuuagguucuagauaggugucuuu

SEQ ID NO: 8052 - RNA, 62 nt, Human
uggugaguguauucuuauauuaagaauaucuuagucaucucaaaacuagcaaaauuuaaauu

SEQ ID NO: 8053 - RNA, 63 nt, Human
uggugauuacuuuuacuacauagaaaaacauuuuagugacuuacagaggauuuuuauuuguga

SEQ ID NO: 8054 - RNA, 62 nt, Human
ugguggauguagcacaauuuccacacugugaaggcaguauuagaagacuuaauuguaaaagc

SEQ ID NO: 8055 - RNA, 62 nt, Human
uggugggaaucauuccugcuuaaugguaacugaccaguguuacccugagccccgcaggccaa

SEQ ID NO: 8056 - RNA, 62 nt, Human
uggugggagcagaccucuacuguccucuguaacuugcugcuauugaggacaagggaguuuuu

SEQ ID NO: 8057 - RNA, 62 nt, Human
ugguguuagauguuagaaacagaacuguuauuugcaguguuaggucuaggaucccaguucua

SEQ ID NO: 8058 - RNA, 63 nt, Human
ugguuaccauauuuuuaaaaagauuuuuugucagggugacuuaacauggacucuuauagggua

SEQ ID NO: 8059 - RNA, 62 nt, Human
ugguugggaaaugucccucaaaauccugggcacuaugaaggaacccccugcccccucaccuu

SEQ ID NO: 8060 - RNA, 61 nt, Human
ugguuguggccccauagcucaucaccccugucuccugcugaaugugcagggcugauguggc

SEQ ID NO: 8061 - RNA, 61 nt, Human
ugguuguucauuuaggaugcuucuaauucagccacugugaaccauuauaaagguuuuauug

SEQ ID NO: 8062 - RNA, 61 nt, Human
ugguuuccagcuuugccugagggaauuccaacaugagauuaugggcuggcuccauuucuug

SEQ ID NO: 8063 - RNA, 62 nt, Human
ugguuuguuucuaguuugggguaacuacacacaaugcugcuagcaacaguuuuguccauguc

SEQ ID NO: 8064 - RNA, 62 nt, Human
ugguuuuuuggagcaggauuuuguguaagaaugguguuuacaugcaguguguuuucccccuc

SEQ ID NO: 8065 - RNA, 63 nt, Human
uguaaaaaaccagccaagcaaggccauaaagggaggugacuuaaaaaagaaaauggauuagug

SEQ ID NO: 8066 - RNA, 62 nt, Human
uguaaaaucuuaagccaauggaacccuugauuuccuaccucaguguacacccaacuauuggu

SEQ ID NO: 8067 - RNA, 64 nt, Human
uguaaacuugguacuacauaaugacuugcuccacacaugcaguaaacuacauaaugauguacug

SEQ ID NO: 8068 - RNA, 62 nt, Human
uguaaaguaaaaugccuuauauauuaaagaguaagugcaauaauaugaaauagccuguacau

SEQ ID NO: 8069 - RNA, 62 nt, Human
uguaaauuauaaguaacuugucaaggaauguuaucaguauuaagcuaaugguccuguuaugu

SEQ ID NO: 8070 - RNA, 62 nt, Human
uguaaauuuacaauuguccuuuacuguacuuuuuuguuuacaguauaguaccuuauuuucug

SEQ ID NO: 8071 - RNA, 63 nt, Human
uguaacaaagagaaaugugcaaauauuuuuuaaggcaguauuaagugcaagaggaguaacaug

SEQ ID NO: 8072 - RNA, 62 nt, Human
uguaacaagaaaacauaagagagccuugguucaucaguguuaaaaaauuuuugaaaaggcgg

SEQ ID NO: 8073 - RNA, 62 nt, Human
uguaaccuagaccuggccacgaaaccuugggcuccuaccucauuaccauuucuacccaaggg

SEQ ID NO: 8074 - RNA, 62 nt, Human
uguaagucuuugcauuuaagacauccaaucaauaaugaaggaaauuuuuuucugaauguagg

SEQ ID NO: 8075 - RNA, 62 nt, Human
uguaauaaauguguauuuuuguacuugcagaaacugcugcuaacuuuuaaaguuguuugguu

SEQ ID NO: 8076 - RNA, 62 nt, Human
uguaauauaccaauuaguuuuauauaauauccucauaagcuauucuaauuuuugagagaaac

SEQ ID NO: 8077 - RNA, 62 nt, Human
uguaauuuuaugcuucagagaugaagauacuguuuguuuacaaagaguuuaguuuuuaagac

SEQ ID NO: 8078 - RNA, 64 nt, Human
uguacaaauugcucuuccagguaauccaccacgguuaacuggaaaagcacuuucagucuccuau

SEQ ID NO: 8079 - RNA, 64 nt, Human
uguacaauguaaggguuuuagggagcaacaguauuuaacuggaagaaagaauugcauauuuaau

SEQ ID NO: 8080 - RNA, 62 nt, Human
uguacaguguuauuuucuguacuucugaauaaaugugcaauauuggaaauuugggaaagcug

SEQ ID NO: 8081 - RNA, 63 nt, Human
uguacguccccacgaacuggccuggccagcaccccacacuggagccaucucuuccucauauuu

SEQ ID NO: 8082 - RNA, 64 nt, Human
uguacucaggucucccuacaguuaaauuuaauguguaacuggaauuacgauucaaagagauagu

SEQ ID NO: 8083 - RNA, 62 nt, Human
uguacucccagcggggguguuuggcccgaggagucaguguuauuacugguggaugcaccgug

SEQ ID NO: 8084 - RNA, 62 nt, Human
uguacuuucuguaguuucuguguaaacugccauauguuuacauggaaacuacaggaaaaaau

SEQ ID NO: 8085 - RNA, 62 nt, Human
uguacuuuggaauucuuagucacaaaauauauuuuguuuacaaaaauuucuguaaaacaggu

SEQ ID NO: 8086 - RNA, 62 nt, Human
uguacuuuuucaugaaaaggaaaaaugguuaacauguuuacacaagaaaaaaagucaaaauu

SEQ ID NO: 8087 - RNA, 62 nt, Human
uguagaaaguuguggcuagaucucauaaauauaacaguauuaaggccauaaaauuugguuaa

SEQ ID NO: 8088 - RNA, 62 nt, Human
uguagaagcuuaaauauguaauguaaccaaacuccaguauuaaaaaucucucauguuguuuu

SEQ ID NO: 8089 - RNA, 62 nt, Human
uguagaccuguuuggggucuacuauuguuuuagaaugaaggaauuguauuauuguguguaua

SEQ ID NO: 8090 - RNA, 62 nt, Human
uguagaguuuuuaaacaucaaucuuuaaaccaauugcugcuacuuauauaauugccaaaaag

SEQ ID NO: 8091 - RNA, 62 nt, Human
uguagauaaaucuuauucuuuucauucuuuccccuguuuacauccuuuuuacaaagcuuagu

SEQ ID NO: 8092 - RNA, 62 nt, Human
uguaguaaugaaaauaccaaguugcaacauuacauguuuacaaaaaaaaaucuguguuugua

SEQ ID NO: 8093 - RNA, 64 nt, Human
uguaguguaaagaaauuuuaugcggaaaaucuuuauaugcaguauagaaaaguuaacacaagua

SEQ ID NO: 8094 - RNA, 62 nt, Human
uguauacacauggcaaaaugugaagaaacuccuuucaucucagcagguagaggaggacugau

SEQ ID NO: 8095 - RNA, 61 nt, Human
uguauccaaggcagguuagagcuaguguauguuacugugaauuguaauguaguuggauugu

SEQ ID NO: 8096 - RNA, 61 nt, Human
uguaucuacaugacacaugucaagaccaaaauaacugugaaugacacaccuugcuguaaau

SEQ ID NO: 8097 - RNA, 61 nt, Human
uguaugaauguaccauaauauauuugagcagucccugcugacauuuuuuuccuaaccuuuu

SEQ ID NO: 8098 - RNA, 62 nt, Human
uguauggaaauucuuaggauuuuuuuaccagcuuuguuuacagacccaaauguaaauauuaa

SEQ ID NO: 8099 - RNA, 62 nt, Human
uguauguauggaguggguuggggccccaaagcuuugcugcuauugauuuguccccgacagca

SEQ ID NO: 8100 - RNA, 64 nt, Human
uguauguuaacaguacuuuauugagguguaaucugcaugcaguaacaugcacaagucucaaguu

SEQ ID NO: 8101 - RNA, 62 nt, Human
uguauuauuaaauaaauaauuuucaaauguuaaacaguauuaaauggcaccugauuuugugu

SEQ ID NO: 8102 - RNA, 64 nt, Human
uguauucauagggaugguggcucaacaaaucaagcaaacuggaaucaaggggagggggaaggga

SEQ ID NO: 8103 - RNA, 62 nt, Human
uguauucuagaagauauaaaugagagguuuggcuucaucucaguuuagaaauuuauucaaag

SEQ ID NO: 8104 - RNA, 61 nt, Human
uguauucucaugauuuucucucaggaagcacacacugugaauggcagacuuuucauuuagc

SEQ ID NO: 8105 - RNA, 63 nt, Human
uguauugaauaugcuuuccuuccugaaaagaggacacacuggagcugcagagacuguauucag

SEQ ID NO: 8106 - RNA, 62 nt, Human
uguauugagauuuggccucugaagaacacuuuuucaguguuaaguuucuuuaccuuaagauu

SEQ ID NO: 8107 - RNA, 62 nt, Human
uguauuggucuuucuccguguucuuuggggguuuuguuuacaaacuucuuuuuguauugaga

SEQ ID NO: 8108 - RNA, 62 nt, Human
uguauuuauuaaauguguuuuuccuuaccuuuugugcugcuacuuugcuaaucucauuagcu

SEQ ID NO: 8109 - RNA, 62 nt, Human
uguauuucugaaucaguccgcuaauaugauugugcaguauuagcuugcuuuugcugcugugu

SEQ ID NO: 8110 - RNA, 62 nt, Human
uguauuuggagaaacaggaguguucacuuaucuagugcaauauguucacaguuuauuaaugc

SEQ ID NO: 8111 - RNA, 62 nt, Human
ugucaaagugaugaauauggaauauccaauccugugcugcuauccugccaaaaucauuuuaa

SEQ ID NO: 8112 - RNA, 61 nt, Human
ugucacaaaaaggaggugccccccugugcugucacugugaauggaaaggaugggucaccuc

SEQ ID NO: 8113 - RNA, 64 nt, Human
ugucacuagagcaaaauuguagagauaaugcucauaaugcaguaaauaucagaauaauaucuac

SEQ ID NO: 8114 - RNA, 62 nt, Human
ugucagacuuugcugcauuuuacacaugugcugauguuuacaaugaugccgaacauuaggaa

SEQ ID NO: 8115 - RNA, 62 nt, Human
ugucagcguccuuauuuauugguucuugaaguuuugcugcuauguuacugaaucauacuaaa

SEQ ID NO: 8116 - RNA, 63 nt, Human
ugucaggccugggguggguaaguccugcgauguggacacuggagaaaguggauccucuaaacu

SEQ ID NO: 8117 - RNA, 62 nt, Human
ugucaguugagauuaaaaguaaggaacagagaaugugcaauaccgucuggcugggggcuguc

SEQ ID NO: 8118 - RNA, 55 nt, Human
ugucauccucagaaugugaaagcuguuugagauuaaaauuugugucaauguuugg

SEQ ID NO: 8119 - RNA, 62 nt, Human
ugucaugagaguggggagacaggcagcaaagcuuaugaaggagguacagaauauucuuugcg

SEQ ID NO: 8120 - RNA, 62 nt, Human
ugucauggggaccccaagccccuuccuccauuuauguuuacaguugugacuuagguauucac

SEQ ID NO: 8121 - RNA, 62 nt, Human
uguccaagaaagaaagcuucuugauugagguagcaugaaggaugaggcuucagcccccauug

SEQ ID NO: 8122 - RNA, 62 nt, Human
ugucccaucgcccugugcaccguagagaccucagucaucucaaggaagaauacauuugcuuc

SEQ ID NO: 8123 - RNA, 62 nt, Human
uguccccucuggguuccacuugagguugugccgaugcugcuaccacacugucgagcccaggu

SEQ ID NO: 8124 - RNA, 62 nt, Human
ugucccuggagccucucuaacuggaaguagcaguucaucucaugacaccccacauuuuauuc

SEQ ID NO: 8125 - RNA, 62 nt, Human
ugucccuggcgcugugcuagcuuuccuuuacagcuguuuacagacaaggcaggccugaggca

SEQ ID NO: 8126 - RNA, 61 nt, Human
uguccucuuuacuccccaccccagugcgucucgccugcugagcccaccgcuuucucagcgu

SEQ ID NO: 8127 - RNA, 62 nt, Human
uguccuguagcuugauauuacagaugugcuauuagugcaauaaggugaaggcugucugccca

SEQ ID NO: 8128 - RNA, 62 nt, Human
uguccuugcaaaagggauuuuguguaaaaagugucaguguuagugacucaucugcaagaauc

SEQ ID NO: 8129 - RNA, 64 nt, Human
ugucgagugaucuuaagacagcuggauguccgaaccaugcaguaauagcagagaaccugcggaa

SEQ ID NO: 8130 - RNA, 62 nt, Human
ugucguuugaaucacaguauacgcuccaucgcugucaucucagcuggaucuccauucucuca

SEQ ID NO: 8131 - RNA, 61 nt, Human
ugucuagaucuuugagaucuguggcugcagggcccugcugauuguaagguaaagcccuggg

SEQ ID NO: 8132 - RNA, 62 nt, Human
ugucuauuauucauucaacucuuuuuacagaccucaguauuagucugugacuacaaaauauu

SEQ ID NO: 8133 - RNA, 63 nt, Human
ugucucaaaugucucguaucaguuuuaguguuuuucaguauuagggaaagguaauauaaaaac

SEQ ID NO: 8134 - RNA, 63 nt, Human
ugucucugcccgcucucgccugcccccagacuacugugacuuaaaaagagggaagaggagcca

SEQ ID NO: 8135 - RNA, 57 nt, Human
ugucucuuccaaccucugaaaaaccaucgaugaaggaauaucucuucucagaaggaa

SEQ ID NO: 8136 - RNA, 61 nt, Human
ugucugaggucacauugcaagugagugcaggagugagauuaucgaaaauuauaauauacaa

SEQ ID NO: 8137 - RNA, 63 nt, Human
ugucugaguugagauuucagguugugacacuugccgugacuuauuuguaaaugacauuuugug

SEQ ID NO: 8138 - RNA, 62 nt, Human
ugucugcccuguuaaacuuggugcccauuaacaguguuuacacuguucaucgugccuguuaa

SEQ ID NO: 8139 - RNA, 63 nt, Human
ugucuggggaugugaugcuuugaaaaaucuaaucagugacuuaagagagauuuucuuguauac

SEQ ID NO: 8140 - RNA, 62 nt, Human
ugucugggucuauucccacacuuacugaguacagaugaaggaaagugguagcaauuuaauca

SEQ ID NO: 8141 - RNA, 62 nt, Human
ugucuggguugcuuauuucccucaucuugcccccucaucucacugcccaguuucuuuuugag

SEQ ID NO: 8142 - RNA, 62 nt, Human
ugucuuaaacuuuaauaaauucgcauuuuaaagguguuuacagauuauuuuuuauaucugua

SEQ ID NO: 8143 - RNA, 62 nt, Human
ugucuuaacauaguacguggcacguuaugccuuucaguguuaacuccuuucuuuuuaaauaa

SEQ ID NO: 8144 - RNA, 62 nt, Human
ugucuuagauugauaaauuagguauggaauccaucaguguuacgugaugagaauaggugaac

SEQ ID NO: 8145 - RNA, 64 nt, Human
ugucuucucuuuaguaugaucccucaaaaccucacuaacuggaaggaugauuuugucucaguuu

SEQ ID NO: 8146 - RNA, 61 nt, Human
ugucuucuuauccccuuggugggcuggguucauacugugaaauaaacuaaaaugaaaccaa

SEQ ID NO: 8147 - RNA, 61 nt, Human
ugucuugcgagcuguuguaguuacaguaaauacacugugaagagacuuuauugccuauuau

SEQ ID NO: 8148 - RNA, 62 nt, Human
ugucuuguuucuucuuuauguuucuuuuacuuauugcugcuaggauccuacauaggauuucu

SEQ ID NO: 8149 - RNA, 64 nt, Human
ugucuuuguaaaaaucccccucuccccuuuucugguaacuggaaaagcaugcuaaaaauagucu

SEQ ID NO: 8150 - RNA, 62 nt, Human
ugucuuuguccacaaaugaaauauguuguaaggucaguguuaauuucgugagacgauauaga

SEQ ID NO: 8151 - RNA, 62 nt, Human
ugugaaaaauugacagcucccucacucuuaagguugcugcuauauacagucuagguuuucug

SEQ ID NO: 8152 - RNA, 62 nt, Human
ugugaaauaagcugagauggcuacaugauauucuucaucucauccugugggauucugcaauc

SEQ ID NO: 8153 - RNA, 61 nt, Human
ugugaaaugcuaaugacaagccugagaagguaaacugugaaucuucauuucuaucauugau

SEQ ID NO: 8154 - RNA, 62 nt, Human
ugugaaauguauuaaguugugguucuuauugaaacaguauuauauaauguuugcuuaauuau

SEQ ID NO: 8155 - RNA, 62 nt, Human
ugugaacucaggaaugcacaguugacuugggaagcaguauuacuagaucuggaggcaaccac

SEQ ID NO: 8156 - RNA, 64 nt, Human
ugugaagccaaaagggaccaggaaccgugcaaaggaaacuggaaacuuuuccccgcuggguaga

SEQ ID NO: 8157 - RNA, 62 nt, Human
ugugaagcuugauuucugcuggugacuucugaccauaagcuagaaccauggucgccacuguu

SEQ ID NO: 8158 - RNA, 63 nt, Human
ugugaaucauacuauauuccccuaaaguaaaaccagugacuuagugguuuuugguuuauuuag

SEQ ID NO: 8159 - RNA, 62 nt, Human
ugugaauucaccagcaagauguacagaacgccuguguuuacauuguuuuuauggaacuagca

SEQ ID NO: 8160 - RNA, 62 nt, Human
ugugacccuaugcaugaaugaggguugaagccuacuaccucacacauccagaaggcucuggg

SEQ ID NO: 8161 - RNA, 64 nt, Human
ugugacucaaaguagugccacugcagugucuuuuuaaacuggaaacagaauuggaaaacugccu

SEQ ID NO: 8162 - RNA, 62 nt, Human
ugugacugaggcccaggagggaccugugagggucuguuuacagaggcugggcaggggccgcu

SEQ ID NO: 8163 - RNA, 63 nt, Human
ugugacugucucggaugaagugacugacccagugcacacuggaucaaaaugcugcuuuccucu

SEQ ID NO: 8164 - RNA, 62 nt, Human
ugugacuucugcgagguccagaucacugaauucauguuuacauucucgugcaagcagggacc

SEQ ID NO: 8165 - RNA, 62 nt, Human
ugugagaugaggggucacauaaccacacuguugacuaccucauuccugguuuuuggccucca

SEQ ID NO: 8166 - RNA, 62 nt, Human
ugugagcugugggacuuuaggcaaguuaucuaaaugcugcuaugcuauagucuccccaccug

SEQ ID NO: 8167 - RNA, 62 nt, Human
ugugaggggacaggccugugcgugccauccagagucaucucagcccugccuuucucuggagc

SEQ ID NO: 8168 - RNA, 62 nt, Human
ugugaugaauuguggcaaguuaacuucaaguuaugugcaauacuuauuucaaacuuuugaaa

SEQ ID NO: 8169 - RNA, 62 nt, Human
ugugaugaggcaggcacaccugucggucuuggcuugcugcuagaacuagggccuucugcucg

SEQ ID NO: 8170 - RNA, 64 nt, Human
ugugauuguuugcaguaugaagacacauuucuacuuaugcaguauucucaugacuguacuuuaa

SEQ ID NO: 8171 - RNA, 49 nt, Human
ugugcagaccaaguguuaaaauguuuacaaaagacagugaaggauucuu

SEQ ID NO: 8172 - RNA, 61 nt, Human
ugugcagcuuugcuagggaagaaagugguguggccugcugagaaaucagcggcuccucccc

SEQ ID NO: 8173 - RNA, 64 nt, Human
ugugcaggggcagagaaggaagggaccaggggacugggccaguauguggaggauggggccugcg

SEQ ID NO: 8174 - RNA, 61 nt, Human
ugugcagugaagguugcugaggcucugacccagugagauuacagaggaaguuauccucugc

SEQ ID NO: 8175 - RNA, 62 nt, Human
ugugcaguuugaagauaguccauauuuccuauuucaguauuagguccugcaacacuuuucaa

SEQ ID NO: 8176 - RNA, 62 nt, Human
ugugcauuaauauuuucaauuuguuuaaccacuuugcugcuaagauuuugccgucccauucc

SEQ ID NO: 8177 - RNA, 64 nt, Human
ugugcccacugccuaccgcgugagccgcagcccuggggccaguaggaagcggacccgcuccaga

SEQ ID NO: 8178 - RNA, 62 nt, Human
ugugcggguuaucauuuuucaaagaaaauuauucucaucucaaugccaaaaagauaguuucu

SEQ ID NO: 8179 - RNA, 62 nt, Human
ugugcucugaaaugccacuugguagcucuggacaaugaaggacaauugacucaagggugccu

SEQ ID NO: 8180 - RNA, 61 nt, Human
ugugcuguucccgaggggagcuugggauuggguccugcugaagccaggagggucuucccaa

SEQ ID NO: 8181 - RNA, 62 nt, Human
ugugcuuaaucucagaugaaccauuucaccauggcaguguuaucucaucucugggcuuuucu

SEQ ID NO: 8182 - RNA, 62 nt, Human
ugugcuuuuccuuguguuuucauguuuuggguaucaguguuacauuaaaguugcaaaauugu

SEQ ID NO: 8183 - RNA, 61 nt, Human
uguggaaagagcguccauaggagaagugagaauacugugaaaaagggauguuagcauucau

SEQ ID NO: 8184 - RNA, 64 nt, Human
uguggacaggauucgauuaaguauucccucuugucaaacuggaagcuaggggaaaaagagggau

SEQ ID NO: 8185 - RNA, 62 nt, Human
uguggagaaaaacuauuuugagccaugggguugguguuuacaagaacuuuccacuuuugcca

SEQ ID NO: 8186 - RNA, 62 nt, Human
uguggagcucagccccgagcuguccccguguugcaugaaggagcagcauugacugguuuaca

SEQ ID NO: 8187 - RNA, 61 nt, Human
uguggcccgaggaagcuggacagcggcagugggccugcugaggccuucucuugaggccugu

SEQ ID NO: 8188 - RNA, 63 nt, Human
ugugggacacauguaccaccuacaagugucagaagacacuggagggccaugauggcaucgugc

SEQ ID NO: 8189 - RNA, 62 nt, Human
ugugggacagcugccuucccacgaaaguguaaagcaguauuaagaucauuacugcaugugcc

SEQ ID NO: 8190 - RNA, 62 nt, Human
uguggggcuuagaagaaugauguuugguuugguaugcugcuaacuaguuguaagacuuuaca

SEQ ID NO: 8191 - RNA, 62 nt, Human
ugugggguggcugggagacagacuucaacucuauaugaaggaauggauggcuuuugugggcc

SEQ ID NO: 8192 - RNA, 64 nt, Human
ugugggguuagcagaucgaauaacuugaaauagaccaugcaguauuccuagcacucaauguaau

SEQ ID NO: 8193 - RNA, 64 nt, Human
uguggucaguuccaacagcacuguccguacuuuuaaaacuggaaugaccuccuucagauaucgu

SEQ ID NO: 8194 - RNA, 64 nt, Human
ugugguccugaugggcccacaaguuuuucuauauuuaacuggaaauaugcuuugauuuuguguu

SEQ ID NO: 8195 - RNA, 62 nt, Human
ugugguuuaugcugcugcugugcuaagacugccuaugaaggaaaauauuccagaucccuccu

SEQ ID NO: 8196 - RNA, 64 nt, Human
uguguaaaaugguauauucuuuaaaauaguguugauaacuggaauauuguauguaugcuuggag

SEQ ID NO: 8197 - RNA, 63 nt, Human
uguguaagcagcugggugccuggggccucucgugcacacuggauugguuucucaguugcuggg

SEQ ID NO: 8198 - RNA, 62 nt, Human
uguguaauguuuaauucuugcaacugaaucaaaacaguguuaaauuauggcaauauuugcac

SEQ ID NO: 8199 - RNA, 62 nt, Human
uguguaauuaaaauggguaguacuguuuaccuaacuaccucauggauguguuaaggcauauu

SEQ ID NO: 8200 - RNA, 64 nt, Human
uguguaccaagugaauuuaaauaauugguguggauuggccaguagcuaagaagugggcuuuuaa

SEQ ID NO: 8201 - RNA, 62 nt, Human
uguguauuuauacccccaggaaacuagcuuuugccaguauuaugcauauauaaguuuacacc

SEQ ID NO: 8202 - RNA, 63 nt, Human
ugugucccuaacagugagguuccaucacaaaggggcaguauuaauuagcagcagcgugcagcu

SEQ ID NO: 8203 - RNA, 62 nt, Human
uguguccucucugcccagccuggcuuaccaagggcuaccucagugggagaugagguuggagg

SEQ ID NO: 8204 - RNA, 64 nt, Human
uguguccuggcaggaagccaccauuggagaaggugaggccaguaaccaucucaugggauucgcu

SEQ ID NO: 8205 - RNA, 62 nt, Human
ugugucuccuaaggugcucgcuucagucagcacuucaucucaggcaaccacaggugacaguu

SEQ ID NO: 8206 - RNA, 62 nt, Human
ugugucucguaaaggucaucucacggaauccaauugcugcuaccucaccauguugcugugcc

SEQ ID NO: 8207 - RNA, 62 nt, Human
ugugugcguggcuaucaggaguucuaggaacucagugcaauacgggagugacccagcuacug

SEQ ID NO: 8208 - RNA, 62 nt, Human
ugugugcuaugacuaaaaauugaaaaauuaaacacaguguuagucaaccuuuuagccucugg

SEQ ID NO: 8209 - RNA, 62 nt, Human
uguguguacuuugauuuuauaacuuguaaucuuuuguuuacaaugaggggcuuucuguaacu

SEQ ID NO: 8210 - RNA, 62 nt, Human
ugugugugaagauuccugacuuagggguggcuuuuguuuacaagaugcaagaggggaaaccu

SEQ ID NO: 8211 - RNA, 61 nt, Human
uguguguguguguguguguguguguguguggcaacugugaaugggauuugacucaguuuga

SEQ ID NO: 8212 - RNA, 62 nt, Human
uguguguguguuuuuuuuaauuugguugaacauuugcugcuaaugggacuugcccagcugag

SEQ ID NO: 8213 - RNA, 62 nt, Human
uguguuaagccugugguuuaguuuuaaguuaaugucaucucagggcuaaaguuuguccaauu

SEQ ID NO: 8214 - RNA, 63 nt, Human
uguguuccucaagcugcacuuuggggccaucucugcaguauuagcccccuuuuugcuuggugg

SEQ ID NO: 8215 - RNA, 62 nt, Human
uguguucuuuucugaauuucauuucagcaauuuaugcugcuaaauagaaucccgcaugucug

SEQ ID NO: 8216 - RNA, 64 nt, Human
uguguugaauacuuacucuagaauaacuacuuuuggaacuggaagggggaaaucuguaaaugga

SEQ ID NO: 8217 - RNA, 62 nt, Human
uguguuuacacaaauuucaucucagcuuugaaaaugcugcuauuaguuuccacuguugguga

SEQ ID NO: 8218 - RNA, 61 nt, Human
uguguuuggcauaccagugaaugaugaagaacaugagauuaauuuaauuuaucuucgguaa

SEQ ID NO: 8219 - RNA, 63 nt, Human
uguguuuuaaaccucagaaacagauuugaguguuucaguauuauagaaacagugaugacuauu

SEQ ID NO: 8220 - RNA, 62 nt, Human
uguguuuuuccuuuuuaggguuacuuuugacucacaguguuaggcaagccagcuuggaaguu

SEQ ID NO: 8221 - RNA, 62 nt, Human
uguuaaaagaaagucauguugucguuuacuaucuucaucucacccauuucaagucugaggua

SEQ ID NO: 8222 - RNA, 62 nt, Human
uguuaacaacguuaguggacacuuguaagucaaucaguguuaaaguauuuguaaauagaagc

SEQ ID NO: 8223 - RNA, 61 nt, Human
uguuaagacucgugaaaagaauuacuauaagguacugugaaauaacugcgauuuugugagc

SEQ ID NO: 8224 - RNA, 63 nt, Human
uguuaagcucacccuguucuuugaagcacccaugucaguauuagaagaauaggcagcaguucc

SEQ ID NO: 8225 - RNA, 62 nt, Human
uguuaauauauaagaaaucuggggauaauuaagaaugaaggacuuuucuaucauuuccauuu

SEQ ID NO: 8226 - RNA, 62 nt, Human
uguuaaucugagagcagugucgccauaguuguguuguuuacaauacucuauaaauggguucc

SEQ ID NO: 8227 - RNA, 62 nt, Human
uguuaaugcauuuuugaugggaagaaaagguacauguuuacaaagagguuuuaugaaaagaa

SEQ ID NO: 8228 - RNA, 63 nt, Human
uguuaauugguuugggagccuccuaugugugacuuaugacuucucuguguucuguguauuugu

SEQ ID NO: 8229 - RNA, 62 nt, Human
uguuaauuuauuuuauagugauuugguucaaagauguuuacaggacacacacacacacacac

SEQ ID NO: 8230 - RNA, 62 nt, Human
uguuacuggaaaauuaggacauguaaauggauaagugcaauaaaguuuccuaaaugcugagg

SEQ ID NO: 8231 - RNA, 62 nt, Human
uguuacuuacuguacuauggaagcuccuggugaauguuuacaauuaugggauguaguauuuc

SEQ ID NO: 8232 - RNA, 62 nt, Human
uguuagaaguagaugacuucaauuaaacaaauuuaugaaggacauuauucugauucauaaaa

SEQ ID NO: 8233 - RNA, 63 nt, Human
uguuagaaucugccuucccugaagugcgcucacuaacacuggaagcccucuuggaaaaguucu

SEQ ID NO: 8234 - RNA, 63 nt, Human
uguuagauuuuguguguaacaguguuguaccuggacaguauuagaaauuuguaugcuuauucu

SEQ ID NO: 8235 - RNA, 62 nt, Human
uguuauuacuuuguguaacuuugauguaauguuuauaagcuaugagaaucaguuauaaaagu

SEQ ID NO: 8236 - RNA, 62 nt, Human
uguuauugaguuguacuguaccuuauuuggaaggaugaaggaaugaaucuuuuuuuccuagc

SEQ ID NO: 8237 - RNA, 62 nt, Human
uguuauuugagguacuuugggaagaugugaauuucaguguuagauucauagugauaagaacu

SEQ ID NO: 8238 - RNA, 62 nt, Human
uguucaacugauauuuuuaaaauucuaauaaucuucaucucaaauguagcauuaguauuucu

SEQ ID NO: 8239 - RNA, 64 nt, Human
uguucaaggcaggugccuuggaaucugcugugaguuaugcaguacuaaccaaacaaaguugcua

SEQ ID NO: 8240 - RNA, 62 nt, Human
uguucacaacuuccauaagauacugcuaaugcaccaguauuaaaacacaucgacguaaguag

SEQ ID NO: 8241 - RNA, 62 nt, Human
uguuccaggguucucuuguuuugaucugcaugucuguuuacacuucucuguaggcguggguu

SEQ ID NO: 8242 - RNA, 64 nt, Human
uguucguucugagccuucaaggaauuuguuuuuuacaacuggaauaugcuccuguguguguuaa

SEQ ID NO: 8243 - RNA, 62 nt, Human
uguucuauaguaguuacaacaauuucacaaccuauguuuacagauucuucauaaauacaugc

SEQ ID NO: 8244 - RNA, 62 nt, Human
uguucuuuaacuauauacuauguaacaggguaaacaguguuauguagaauagaauuguguaa

SEQ ID NO: 8245 - RNA, 62 nt, Human
uguucuuuacaaaggcuagcucaguccaacacuguguuuacauacacucgugcuuuuccuua

SEQ ID NO: 8246 - RNA, 62 nt, Human
uguucuuucuaugcuuuccucaccaucaucacaguguuuacaaacuuuugaaaauauuuagu

SEQ ID NO: 8247 - RNA, 64 nt, Human
uguugaaaauuggaaaagaauggacugaagucuaaaaacuggaauaaugaaggacacuaaaugc

SEQ ID NO: 8248 - RNA, 63 nt, Human
uguugaaacuguuaaaauuccaauuuguuuucauucaguauuaguuuaguucuaaauauagca

SEQ ID NO: 8249 - RNA, 64 nt, Human
uguugcaugugaauccacauccugaagggaggcuacaacuggaauaaaaauaagaaagcuuuca

SEQ ID NO: 8250 - RNA, 58 nt, Human
uguuggagaaaaaccuuaguugaugugauggugcaauaaagucuucacucagucuuca

SEQ ID NO: 8251 - RNA, 62 nt, Human
uguuggauugcagagacauuuucuggagugauccaugaaggaccauuaaccugugauaccuu

SEQ ID NO: 8252 - RNA, 61 nt, Human
uguugggacagucaguugguauguauccaagucccugcugaccacuaauguucuagcugau

SEQ ID NO: 8253 - RNA, 64 nt, Human
uguugguaacuucacuagagcauacauaacaacuggaacuggaaauuauacaaaaguaaauugg

SEQ ID NO: 8254 - RNA, 64 nt, Human
uguuggugaaauugcuguggggguaucgggggauauggccaguaaaguauugagagacuaacaa

SEQ ID NO: 8255 - RNA, 64 nt, Human
uguugguucauuugguguauggggggacaucaugguaacuggaaaugaaaguuuaaucuuucac

SEQ ID NO: 8256 - RNA, 62 nt, Human
uguuguagcacgaaagcagccagguaauuacuagaugaaggaaugcagguggcuguguuuca

SEQ ID NO: 8257 - RNA, 62 nt, Human
uguugucaguccagcaauugaggcuuucauaguucaguguuauaauauucaguagggacccu

SEQ ID NO: 8258 - RNA, 62 nt, Human
uguuguuagcaucuuuguaugcacaucacuguuugugcaauauaugaauauuuuguugcauu

SEQ ID NO: 8259 - RNA, 63 nt, Human
uguuuaaaaucaagaguguauuguuuacuguuuuacaguauuauuuaauauccaacuggucuc

SEQ ID NO: 8260 - RNA, 63 nt, Human
uguuuaacauaauaauguuuuaaagacuuaguugucaguauuaaauaauccuggcauuauagg

SEQ ID NO: 8261 - RNA, 61 nt, Human
uguuuacuaacauacucauucuucacaaaauucugagauuauaaaauguauauaguuaaua

SEQ ID NO: 8262 - RNA, 64 nt, Human
uguuuaguggggaaagggacggggugcagacggcagggccaguauggggcccccucccucuccu

SEQ ID NO: 8263 - RNA, 62 nt, Human
uguuuauaaaguuuuauggauuuuuacagugaaguguuuacaguuguuuaauaaagaacugu

SEQ ID NO: 8264 - RNA, 63 nt, Human
uguuuaugcugugauuucacucugucuaucaugggcaguauuagaaaacacacugguuuucac

SEQ ID NO: 8265 - RNA, 62 nt, Human
uguuucaaauacagugcagucaguuuuauaugaugugcaauaaaccaaaaaggcuuuauuaa

SEQ ID NO: 8266 - RNA, 64 nt, Human
uguuucaucguuacuaccauguguuccgugagggagaacuggaaggugccugcaggacugugag

SEQ ID NO: 8267 - RNA, 62 nt, Human
uguuucauguccauucaagugacuuuuauucugagugcaauauuucaauagccuuguaguga

SEQ ID NO: 8268 - RNA, 62 nt, Human
uguuucuucauuauuaaaacauaaaucaaucauauguuuacagaugacuugcuggcagacag

SEQ ID NO: 8269 - RNA, 63 nt, Human
uguuucuucgagccuaaccgagcacauacgaacucacacuggagagaaaccuuaugaauguaa

SEQ ID NO: 8270 - RNA, 62 nt, Human
uguuucuuuuuuuuuaacuggucagucauucacaauaagcuaugaggguaaauaaauaugug

SEQ ID NO: 8271 - RNA, 63 nt, Human
uguuugagcccaacacuuuaauuuauucuuucuggacacuggagucacuaacuggcguguuuc

SEQ ID NO: 8272 - RNA, 62 nt, Human
uguuugauuuggaugauugugugacuauucauggcuaccucagaaagauuugaugggccaca

SEQ ID NO: 8273 - RNA, 64 nt, Human
uguuugcuuucucccauuuuuaagagaugguaaguuaacuggaauugauuuacugaaugaaauu

SEQ ID NO: 8274 - RNA, 62 nt, Human
uguuuguacuacuuuuuagaugcuuaaacuauacauaagcuauuaucuauuguuccuaguaa

SEQ ID NO: 8275 - RNA, 62 nt, Human
uguuuuaagaaacaaaacauaguaucuuauggauuguuuacaaucacaaggacauagauacc

SEQ ID NO: 8276 - RNA, 62 nt, Human
uguuuuauaaaccaaaacaaaauuuccaaaaacaaugaaggaaaccaaaauaaauauuucug

SEQ ID NO: 8277 - RNA, 64 nt, Human
uguuuugcucugucuaaaaacaucugcauaguuuucaacuggaaaaagaaaaaacuuaaaaaug

SEQ ID NO: 8278 - RNA, 63 nt, Human
uguuuuguaagucuacaauuugccaagaguaaauaacacuggaccagcuguaaaaguaaacag

SEQ ID NO: 8279 - RNA, 63 nt, Human
uguuuuucuguguuguuuucccuggaugaaaauaucaguauuaaguagacagcauauuauuca

SEQ ID NO: 8280 - RNA, 63 nt, Human
uguuuuuguuuuuuaaguagccacuuuuaauuacucaguauuaauccuaggugcauguguuaa

SEQ ID NO: 8281 - RNA, 62 nt, Human
uguuuuuugcaaauuagagcaggacaaacuuuuauguuuacagggcacgucuguuguaaugc

SEQ ID NO: 8282 - RNA, 62 nt, Human
uuaaaaaagaaacuugucugccacaguauguuaccaguguuaacccuucugcaguuagcaaa

SEQ ID NO: 8283 - RNA, 61 nt, Human
uuaaaaaaugccuccaaaaaugagauagguuuaccugcugaacuugaaaauaagaaacuua

SEQ ID NO: 8284 - RNA, 62 nt, Human
uuaaaaacaaacaaacaaaaaaaaaaucuguuagauaagcuaucaaaaugcagcuguuguuu

SEQ ID NO: 8285 - RNA, 63 nt, Human
uuaaaacggaaucucugcacccaaaugcaggacuggugacuuaaggagcugcgaagucugauu

SEQ ID NO: 8286 - RNA, 61 nt, Human
uuaaaagaaucuuguaacuuuauucuuuuuucuccugcugaaaaaaaaaauuaaaccaauc

SEQ ID NO: 8287 - RNA, 62 nt, Human
uuaaaauagaauuuagaguauuugggguuuuguuuguuuacaaauaaucagacuauaauauu

SEQ ID NO: 8288 - RNA, 64 nt, Human
uuaaaauaugcucacaguuuguagucauguagaaaaggccaguauaaaaauguaguagacuuaa

SEQ ID NO: 8289 - RNA, 61 nt, Human
uuaaaauccaccugccuccaccugccaaagugcugagauuacaggcgugagccaccacacc

SEQ ID NO: 8290 - RNA, 62 nt, Human
uuaaaauugaaauuaguuauuuucuucugcuggacaguauuaaauagagcaggauguugagu

SEQ ID NO: 8291 - RNA, 61 nt, Human
uuaaacuuuguuuguagauaaaauagagcacaaacugugaagugcaucuuuccaagaccau

SEQ ID NO: 8292 - RNA, 62 nt, Human
uuaaagaauuauauuggauaaggugguuuucaccauaagcuaauuuacucucugcagccguc

SEQ ID NO: 8293 - RNA, 64 nt, Human
uuaaagccaccacaaggguacagcauuaaauggcagaacuggaaaagcuucuuagggcaucuca

SEQ ID NO: 8294 - RNA, 62 nt, Human
uuaaagcugaaaaauacauuugguucaugugcauuguuuacaaagcaaaaagaaaaaagagg

SEQ ID NO: 8295 - RNA, 64 nt, Human
uuaaagcugcggucuccuguuugauaaaagaauauuggccaguauugcagauuuuaacugauuu

SEQ ID NO: 8296 - RNA, 62 nt, Human
uuaaaggcuuaauuugggaggggggacuuauuucuguuuacaguguauuaccuuccuucccu

SEQ ID NO: 8297 - RNA, 63 nt, Human
uuaaagguguuaauuaauggguauaaaauuuaaaucaguauuacuggcagacguuauuuuagg

SEQ ID NO: 8298 - RNA, 62 nt, Human
uuaaaguucuccuuccgucuuuucucccauuuuacaguauuacucaaauaagggcacacagu

SEQ ID NO: 8299 - RNA, 62 nt, Human
uuaaauacucauuuacaaguuuucuauccuccuucaguguuaaaguagaaaguaaaaagagu

SEQ ID NO: 8300 - RNA, 62 nt, Human
uuaaauaucuagagacauacaaacaucugcuaauucaucucauugagauggaucauucugau

SEQ ID NO: 8301 - RNA, 62 nt, Human
uuaaauaugggaguaaauucagccuuucuucuuuucaucucagucauaacccaaaagcuacg

SEQ ID NO: 8302 - RNA, 62 nt, Human
uuaaaucauucuuguugaacaguuuuuguauguacaguauuaugguacuuuuuuuuuuuuag

SEQ ID NO: 8303 - RNA, 62 nt, Human
uuaaaucuuaccuuuaaaugaagacucuauggauuguuuacaaaugaaguuuuacacuagga

SEQ ID NO: 8304 - RNA, 62 nt, Human
uuaaaugaaagaaguuguaaggauauaaaaaguacaguguuagaugugcacaaggaaaguua

SEQ ID NO: 8305 - RNA, 62 nt, Human
uuaaaugcaucuaacccuuuaacaaauguguacauguuuacaaguaauggaaaugcgucuau

SEQ ID NO: 8306 - RNA, 63 nt, Human
uuaaauggggcagacaauugcaauacuuguacuaaacacuggaauacaaaugcaugacucaua

SEQ ID NO: 8307 - RNA, 63 nt, Human
uuaaaugucucuugcaaaacaaaguaagauaccaccaguauuacaacacaaugauuuuccaga

SEQ ID NO: 8308 - RNA, 64 nt, Human
uuaaauguuugguacauguaaagucuuugaaaguguaacuggaauauuguguaauuuuaauaaa

SEQ ID NO: 8309 - RNA, 61 nt, Human
uuaaauucuagcauuuuagacuaggacuguucuacugugaagaaaguucugucuccuuuag

SEQ ID NO: 8310 - RNA, 61 nt, Human
uuaacacuagcuuuguauuuuuuuuucuguaaaacugugaacugauauauuuuccuuuauc

SEQ ID NO: 8311 - RNA, 62 nt, Human
uuaacagcucauaucaggagcugugauaaguaaguguuuacauacacugucuagugcauaaa

SEQ ID NO: 8312 - RNA, 64 nt, Human
uuaacaguacuaaguggaagggaucugcagauuccaaacuggaauaagcucuaucauauucuga

SEQ ID NO: 8313 - RNA, 63 nt, Human
uuaacauacuguauacucuauagcaguauuacagucaguauuucauauaauuuucuuuagacc

SEQ ID NO: 8314 - RNA, 62 nt, Human
uuaacauuuauagugaggauugacagaaauuaagcaguguuaagaauaccagcauccauguu

SEQ ID NO: 8315 - RNA, 62 nt, Human
uuaacccugucuccucucuguuacucagagggccucaucucagacaaggcccagccugcuuu

SEQ ID NO: 8316 - RNA, 64 nt, Human
uuaacuacuaguuauuugugauagcaacauacacauggccaguaaugcucuuguccaggaagau

SEQ ID NO: 8317 - RNA, 63 nt, Human
uuaacuuaccauaaaugcagugugacuuuucccacacacuggauugugaggcucuuaacuucu

SEQ ID NO: 8318 - RNA, 62 nt, Human
uuaagaauauuauccugguuuaacaacagugcccuguuuacaacagauugugcccuaucuca

SEQ ID NO: 8319 - RNA, 61 nt, Human
uuaagagauuauauaauaugaacuuucacauuuacugugaaaugucuaacuuugccagugc

SEQ ID NO: 8320 - RNA, 62 nt, Human
uuaagaggcaugaaaagcaacuauuguuguguuacaguguuaaaaauauucaguuuucuuug

SEQ ID NO: 8321 - RNA, 62 nt, Human
uuaagcucgccaagucuguguugcugugaaaugaaugaaggagaggcuccuguucaucuugu

SEQ ID NO: 8322 - RNA, 62 nt, Human
uuaaggaaaauuaauaaaucauuaauaguuaaaauguuuacauugagcacuagaacauguuu

SEQ ID NO: 8323 - RNA, 62 nt, Human
uuaagguacgcuugcuugucuuuaaaucuucaauaugaaggacuauuaauuccaagauuaaa

SEQ ID NO: 8324 - RNA, 63 nt, Human
uuaaguaauugccagcuuuuauaccaucaugaguggugacuuaaggagaaauagcuguauaga

SEQ ID NO: 8325 - RNA, 62 nt, Human
uuaaguacuacaauguaaucuguuucccagggaaauaagcuauugguaguuguaggaaaucu

SEQ ID NO: 8326 - RNA, 62 nt, Human
uuaaguagcaguuuuaaaauuccuauucucaaacucaucucagguauauaguacucuaacgu

SEQ ID NO: 8327 - RNA, 64 nt, Human
uuaagucagagauacgugaauggauguaaugccguuaugcaguauauauuguuaauugucauua

SEQ ID NO: 8328 - RNA, 62 nt, Human
uuaagucuguggaucugcugauguacagugccuuugcugcuauggaucaaaaucaaaagaac

SEQ ID NO: 8329 - RNA, 62 nt, Human
uuaaguguauauucuauuuuaauaaaugcuacuuuguuuacaguuaucaguaguuuaaauau

SEQ ID NO: 8330 - RNA, 61 nt, Human
uuaaguguggaaaagaguucagaucucugagacacugugaagaaauggauggcucauguaa

SEQ ID NO: 8331 - RNA, 62 nt, Human
uuaaguuauaaggugaaucaaacaauauguaauacaguauuaggauguaaucuuugcuuuug

SEQ ID NO: 8332 - RNA, 61 nt, Human
uuaauaaaagcaacauguugaaacaagagagggugagauuaaccuuuuugcuaaaguaauu

SEQ ID NO: 8333 - RNA, 62 nt, Human
uuaauagugaggaagccuauuugaacuacuuaaacaguauuaaagcccuuuuuaaaaagcac

SEQ ID NO: 8334 - RNA, 62 nt, Human
uuaauaguugagaauugcuuuuuugaaaauuuucaugaaggaauuuugguaaugacuuugcu

SEQ ID NO: 8335 - RNA, 61 nt, Human
uuaauaugcgauaauaugaagcuuuauauguguacugugaacuuaaauauuucauaucagu

SEQ ID NO: 8336 - RNA, 62 nt, Human
uuaauauuauuguauuaacauuuuaaguauaugguguuuacauucuuauuucuuuugacauu

SEQ ID NO: 8337 - RNA, 63 nt, Human
uuaaucccauugcaaacauuauuccaagaguaucccaguauuagcaauacuggaauauaggca

SEQ ID NO: 8338 - RNA, 64 nt, Human
uuaauccuuuuagggccuugaugucaagaaaaaaauaacuggaaacuauauuuugcuaaagaua

SEQ ID NO: 8339 - RNA, 63 nt, Human
uuaaucuggcacaacacuaauuaccauuuuuaaagcaguauuaaguuguaauuuaaaccuugu

SEQ ID NO: 8340 - RNA, 62 nt, Human
uuaaugacgguuuaaaacuuuuuaaaagaaaacucaguauuauuuuugcauguuuucuaacc

SEQ ID NO: 8341 - RNA, 62 nt, Human
uuaaugcuacuugucucuggaacauuuuuuuuuccuaccucagagauaaaugagaucuccau

SEQ ID NO: 8342 - RNA, 64 nt, Human
uuaauguagugaggauauuauuuaaacuuuuauuuuaacuggaaauguccugaaacacauauuu

SEQ ID NO: 8343 - RNA, 61 nt, Human
uuaaugugguguuacuguaggaauuuucuugaaacugugaaggaacucugcaguuaaauag

SEQ ID NO: 8344 - RNA, 63 nt, Human
uuaauguguaauggagccauucaaugaucaaaaauacacuggaccagauaguagacugguccc

SEQ ID NO: 8345 - RNA, 64 nt, Human
uuaauuauaaaaucauaguauauguucuuuguagaaaacuggaaaaauacauauucaaacagga

SEQ ID NO: 8346 - RNA, 61 nt, Human
uuaauuauggugacaguuccuuauuggugugugugagauuacucuagcaacuauuacagua

SEQ ID NO: 8347 - RNA, 62 nt, Human
uuaauuaugucagagauugcaucauccuucugcuuguuuacaacuaugaucuucuaugaaau

SEQ ID NO: 8348 - RNA, 63 nt, Human
uuaauucagauguuuuacgcaaggaaggacuuacccaguauuacugcugcugugcuuuugauc

SEQ ID NO: 8349 - RNA, 62 nt, Human
uuaauuuauuuuguaaugucuuguuuugaaguauugcugcuauccuuguuauccuucccacu

SEQ ID NO: 8350 - RNA, 63 nt, Human
uuaauuucauuaagaggaacaucaggcauugcaaucaguauuaaucaggggcucaaauacaga

SEQ ID NO: 8351 - RNA, 62 nt, Human
uuaauuuuguaaaugccaaaugaaaaacguuuuuugcugcuauggucuuagccuguagacau

SEQ ID NO: 8352 - RNA, 64 nt, Human
uuaauuuuguugugccugcuucauuuugcaauaacaaugcaguagaauuuaaaacuuggaugcu

SEQ ID NO: 8353 - RNA, 62 nt, Human
uuacaacaagcccuacaauuagagauugcugaacugcugcuaaagugauuuuuuuuuuauuu

SEQ ID NO: 8354 - RNA, 61 nt, Human
uuacaauaugagcuccaagacacuuacugaucuacugugaauauaaaauguuauuagccuu

SEQ ID NO: 8355 - RNA, 63 nt, Human
uuacagaaugacgauacaaaugccaaugaccagaugugacuuauuuuccuuuuacuauacagc

SEQ ID NO: 8356 - RNA, 63 nt, Human
uuacagauaaaacaacugaggcucagggagauucugugacuuaccuaaggccacacaguuagc

SEQ ID NO: 8357 - RNA, 62 nt, Human
uuacaggaacugugcaucagcuauuuaugauucuauaagcuauuucagcagaaugagauauu

SEQ ID NO: 8358 - RNA, 63 nt, Human
uuacagugcuauuacuauaauucaaaauuauguaugugacuuagaguuauauaaucauaauuu

SEQ ID NO: 8359 - RNA, 62 nt, Human
uuacauuuuggucuaaaaagcucuuggauucaucucaucucauggaaugauccugucggaug

SEQ ID NO: 8360 - RNA, 62 nt, Human
uuaccaucuuaaucacuuugaguguacaguucaucaguguuaacuguauucaccuugugcaa

SEQ ID NO: 8361 - RNA, 62 nt, Human
uuacccucuguaagauacugauucuuccuggggccaguauuaccuuguaugcaaauauuaca

SEQ ID NO: 8362 - RNA, 64 nt, Human
uuacccucuuuuugggaacaucaauuuuguacuguuaugcaguaaacauuuauaauaauauaau

SEQ ID NO: 8363 - RNA, 62 nt, Human
uuaccuaaggaaaaagacaguuuuucuagguaccaugaaggaagauugacccuguugguaug

SEQ ID NO: 8364 - RNA, 62 nt, Human
uuaccuguagguggagcaaguaauaagccaugcugugcaauauauacauaaagcuucugcuu

SEQ ID NO: 8365 - RNA, 62 nt, Human
uuaccuuaagcagcacacacauuuacuacacacacaguguuaacaaagcacugugcuuagag

SEQ ID NO: 8366 - RNA, 62 nt, Human
uuaccuuugagucuuuucuuuuguuuaccucuuuucaucucaaagugggaaagcuccagaua

SEQ ID NO: 8367 - RNA, 62 nt, Human
uuacguguugaagaccugacuggagaaacaaaaugugcaauaacgugaauuuuaucuuagag

SEQ ID NO: 8368 - RNA, 64 nt, Human
uuacuaguguuacuuaauguauauucuaaaaagagaaugcaguaacuaaugcccuaaauguuug

SEQ ID NO: 8369 - RNA, 61 nt, Human
uuacucuacccacauucuugccuucucuauccaacugugaaagugaggggaggcuccuguc

SEQ ID NO: 8370 - RNA, 62 nt, Human
uuacucucucagauggcucaucauaggggaaaccugcugcuacaucaugagauagcccugug

SEQ ID NO: 8371 - RNA, 62 nt, Human
uuacuguuguacaaucauguucuggugguuugauuguuuacaggauauuccaaaauaaaagg

SEQ ID NO: 8372 - RNA, 62 nt, Human
uuacuuugagcuaaagacauuucauaaaaugggcaugaaggauuccuucaaaugaagacgug

SEQ ID NO: 8373 - RNA, 63 nt, Human
uuacuuuuuuuuacuuuuauaaugcauuuuacucccaguauuauguucauuuaauaaauuauu

SEQ ID NO: 8374 - RNA, 61 nt, Human
uuagaaaaacuaagguaauuuuacaauauaugcugagauuaaaaaccaagguaaaaaugau

SEQ ID NO: 8375 - RNA, 64 nt, Human
uuagaaaacagaggaguuuguagccagcagccuguaaacuggaaacacuggucucagccaaccu

SEQ ID NO: 8376 - RNA, 61 nt, Human
uuagaaaauaauuauugaaugaaugaaaucuaaacugugaaccugaggguguuuguggcag

SEQ ID NO: 8377 - RNA, 63 nt, Human
uuagaagcauaccauuuuccuuucauggaaggguacaguauuacaaagauaauuuguuuaacu

SEQ ID NO: 8378 - RNA, 62 nt, Human
uuagaaugcccuuccccuaggccugcauggcuugcuaccucacuuaauuguuugacacuucc

SEQ ID NO: 8379 - RNA, 62 nt, Human
uuagaaugcugaaauguuuuugaaguuaaauaaacaguauuacauuuuuaaaacucuucucu

SEQ ID NO: 8380 - RNA, 63 nt, Human
uuagaauguuaauguccuaguauuauuccgaacuacaguauuaacugcuuguugcuaguggau

SEQ ID NO: 8381 - RNA, 61 nt, Human
uuagacuuuccugaaaucucugccauuuuagauacugugaaacaaacuaaaaaaaaaaaag

SEQ ID NO: 8382 - RNA, 62 nt, Human
uuagagaaauguaaauuaaaacugcaaugagacaucaucucacaccagucagaauggcuauu

SEQ ID NO: 8383 - RNA, 64 nt, Human
uuagagaacaacaauauuccuauaguuucuguauuaaugcaguagagacagagguuccuaacgc

SEQ ID NO: 8384 - RNA, 62 nt, Human
uuagagaacucgauggaaaaauguucucuuuaguucaucucagcagacauauuuagggaaaa

SEQ ID NO: 8385 - RNA, 64 nt, Human
uuagagaauguaacugaccaaagucacacugccaggaacuggaagcacuaggauuugacagcau

SEQ ID NO: 8386 - RNA, 62 nt, Human
uuagagauaccagaaugcugguauucuacuacuugugcaauauauauguuuuaaaaaacaaa

SEQ ID NO: 8387 - RNA, 62 nt, Human
uuagauauauuauuugcagcaagaaguucauucugugcaauauggacauguuugcaaaccau

SEQ ID NO: 8388 - RNA, 61 nt, Human
uuagauauuuguggcaaagcagaaagcuuuuugacugugaaggcagaggucagcacugggg

SEQ ID NO: 8389 - RNA, 61 nt, Human
uuagauccuaagucucuuacaaaagcuuugaauacugugaaaauguuuuacauuccauuuc

SEQ ID NO: 8390 - RNA, 62 nt, Human
uuagaugaggaugauugaguccauauacuauguauguuuacauauacuauacaugcacauua

SEQ ID NO: 8391 - RNA, 64 nt, Human
uuagauuaucuuacugguucaacauuuuucugauauaugcaguauuacagauauucagcaaaag

SEQ ID NO: 8392 - RNA, 62 nt, Human
uuagauuuucccauuucuaauaguuggcaccauuauaagcuauaagguucagaaucagaauu

SEQ ID NO: 8393 - RNA, 61 nt, Human
uuagcaggagcgggcccuguacccaccugcugaccugcuguuugguagagaaauaaagguu

SEQ ID NO: 8394 - RNA, 63 nt, Human
uuagcauguguuuauuuuuucauauguacucaaaggugacuuauugguucaccucagugauau

SEQ ID NO: 8395 - RNA, 62 nt, Human
uuagccuuagggaagggaaaacacuaagugaaacuguuuacaauaaccucauacaaccuucu

SEQ ID NO: 8396 - RNA, 62 nt, Human
uuagcuuuaaaaaggaaugaaauucugauaaauacuaccucaggauaaaccuugaaaacacu

SEQ ID NO: 8397 - RNA, 61 nt, Human
uuaggcaauguuuuuaaaacuuaguaaugagaaacugugaaaagagccaaguguuacauug

SEQ ID NO: 8398 - RNA, 62 nt, Human
uuagggaagcuguuggagaaaauacuccagcaaaaugaaggaguacacaaaccagagaauga

SEQ ID NO: 8399 - RNA, 62 nt, Human
uuagggcuuugcauugugucuaauacauugaucccaguguuacgggauucucuugauuccug

SEQ ID NO: 8400 - RNA, 62 nt, Human
uuaggggaaaucaaaucugguugguaggugucuacaguauuagaagaggguauaagggcacu

SEQ ID NO: 8401 - RNA, 64 nt, Human
uuaggggccugucucugcaccugucuguccaucugcaugcaguauucucacccauguugaaugc

SEQ ID NO: 8402 - RNA, 63 nt, Human
uuaguaaguuggguuuagcuuuugugugugcaucagugacuuagaguucuguaauaacuuauu

SEQ ID NO: 8403 - RNA, 61 nt, Human
uuaguaguggguuucuguucuguuggaugacuuugagauuauucuuuguuuccuguuggag

SEQ ID NO: 8404 - RNA, 62 nt, Human
uuaguauuauguaaauuuaugcugcaauagcuuuugcugcuauuaaaaugguauuauuaaua

SEQ ID NO: 8405 - RNA, 64 nt, Human
uuagucuccugggggugaaaacuuggcuuacaagagaacuggaaaaaugaugagaugugguccc

SEQ ID NO: 8406 - RNA, 61 nt, Human
uuaguguguguuuucccuccaagugugauauuuccugcugaauuaaauuauacuucaguug

SEQ ID NO: 8407 - RNA, 62 nt, Human
uuaguucacaagcauaauuuggagguguguucuguguuuacacaguaguuuggauguacaau

SEQ ID NO: 8408 - RNA, 62 nt, Human
uuaguucagagaauugucuuaggacaacaggcuaaugaaggauuuggggucuggguuuuuag

SEQ ID NO: 8409 - RNA, 62 nt, Human
uuaguugaacugugcggaauugugguguugguuuuguuuacacagccagauuuuuccuucuu

SEQ ID NO: 8410 - RNA, 62 nt, Human
uuauaaaaaucuugaguuuguucacuaaugugaaauaagcuauguguccaggguauugcucc

SEQ ID NO: 8411 - RNA, 62 nt, Human
uuauaaauuguugagaaauuuuugugauuagaauaugaaggaaaaagcuuuguugguaaaag

SEQ ID NO: 8412 - RNA, 62 nt, Human
uuauaauuauggacacugcaucaguauacauaacaugaaggaauaaaaaggauacagaauug

SEQ ID NO: 8413 - RNA, 62 nt, Human
uuauacaacuaaucccaggugauuuuaucaauuccaguguuaccaucuccugaguuuugguu

SEQ ID NO: 8414 - RNA, 61 nt, Human
uuauaccuacauggguaacaugugcuaaucaaaccugcugaugcuacaaauguuaauuucu

SEQ ID NO: 8415 - RNA, 63 nt, Human
uuauagucaucuguuaugcugugaaauuuggaauucaguauuaucauuuugaagucuguaaau

SEQ ID NO: 8416 - RNA, 62 nt, Human
uuauaguucuucuccauguuucuccagaauuaaucaguguuaguccucuguuuaucucgcau

SEQ ID NO: 8417 - RNA, 61 nt, Human
uuauauaacgugauacauuuggauaaacaacauugagauuaugaugaaaaccuacauauuc

SEQ ID NO: 8418 - RNA, 62 nt, Human
uuauauauauuuuuugcaacuuggauuuccaguuuguuuacagaguagucuuagguaguagc

SEQ ID NO: 8419 - RNA, 62 nt, Human
uuauauaugauaauuuauauaaaaccacuaauuguuccguuaagcuucacagaaaauaaaac

SEQ ID NO: 8420 - RNA, 62 nt, Human
uuauaugcauuuuuguagggaucagcuugguagacaguauuagcggagaaacaccuugaucu

SEQ ID NO: 8421 - RNA, 62 nt, Human
uuauauucuuuucucauuucuuccccacccaaaaauaagcuaccauauagcuuauaagucuc

SEQ ID NO: 8422 - RNA, 62 nt, Human
uuauauuuuauaaucaagauuaaaucuuauaguuuguuuacaaaauuuugaaaaucaaaugu

SEQ ID NO: 8423 - RNA, 64 nt, Human
uuauauuuuuauuagaaugcaagaauuuugcacauuaacuggaaaagauguuaacaguaaagau

SEQ ID NO: 8424 - RNA, 62 nt, Human
uuaucaacuauuuacaacgucuauacaguauaaacuaccucacuugccuuucuugggaaaaa

SEQ ID NO: 8425 - RNA, 63 nt, Human
uuaucaccugaucagcauaacagaaguagccaaaagugacuuacuggucucauaguucuuauu

SEQ ID NO: 8426 - RNA, 61 nt, Human
uuaucagcgaaaugguccauguuuuuccaauuaccugcugacacgguucuaagcuaaguga

SEQ ID NO: 8427 - RNA, 62 nt, Human
uuaucccgcaagguuuaguugagaagauacaaaauguuuacaguguuggcacuuagaguuuu

SEQ ID NO: 8428 - RNA, 63 nt, Human
uuauccucucaacuagauuguaagcacuuggaggugugacuuacaggucuuuguaucucacac

SEQ ID NO: 8429 - RNA, 62 nt, Human
uuaucucaucuauggacuugccaaacagucuuuuaugaaggaaaguuacaguauuaauuuuu

SEQ ID NO: 8430 - RNA, 63 nt, Human
uuaucucuguaggaacuuuuaguuccauuauaugaacacuggauaaccuaauuuuuuuuaaug

SEQ ID NO: 8431 - RNA, 61 nt, Human
uuaucugcaaacaacuucuuuucuccuucaggaacugugaauggcuagaagaaggagcuca

SEQ ID NO: 8432 - RNA, 62 nt, Human
uuaucugugauucuuucauccucccagaaaggaucaguguuagaaugggaaauagagugugc

SEQ ID NO: 8433 - RNA, 64 nt, Human
uuaucuguggcacagucagugcuguguuugagguaaaugcaguaacgguuaguuuucuacuuug

SEQ ID NO: 8434 - RNA, 62 nt, Human
uuaucuuacugguucaacauuuuucugauauaugcaguauuacagauauucagcaaaaguau

SEQ ID NO: 8435 - RNA, 62 nt, Human
uuaugaguguguguccgcccacccccacccccuucaguguuaaguggggagcccugggggag

SEQ ID NO: 8436 - RNA, 62 nt, Human
uuaugauagaauguaucagaauaaauguuuuuaacaguguuaugcuugagucuuuuuugaau

SEQ ID NO: 8437 - RNA, 61 nt, Human
uuaugauccacccgacuccaccucccaaagugcugagauuacaggagugagccacugugcc

SEQ ID NO: 8438 - RNA, 61 nt, Human
uuaugauucacccaccucuaccucccgaagugcugagauuaugggcgugagccaccgugac

SEQ ID NO: 8439 - RNA, 61 nt, Human
uuaugauugcuguuuuacauaaaaucuaugggaacugugaauacagacaagagagccacag

SEQ ID NO: 8440 - RNA, 61 nt, Human
uuauggaaggcucgaccuugaggggaaaguuuuacugugaaagucuucuucagauccccac

SEQ ID NO: 8441 - RNA, 64 nt, Human
uuauggagcucaugcaggagaaugagcggguggagaaacuggaaugucgcugcauucagcuguc

SEQ ID NO: 8442 - RNA, 62 nt, Human
uuauguaguaaauguauguuuacaggguuuaucauguuuacagauuaagcuaauuucuguag

SEQ ID NO: 8443 - RNA, 62 nt, Human
uuaugugaguugaaucaagaggcucuaggccagauguuuacauaauuuuaaccuauaugauu

SEQ ID NO: 8444 - RNA, 61 nt, Human
uuaugugcuguguucccguuucacuggguaugaacugugaaaucgacugaauccuggccac

SEQ ID NO: 8445 - RNA, 62 nt, Human
uuauguguuauaguuaauauaugcaccuaccuucuuccguuagugcaucaguaaauguguua

SEQ ID NO: 8446 - RNA, 62 nt, Human
uuauguucagauacugagccuucauaaggguugacuaccucagauuugcugcacucauugug

SEQ ID NO: 8447 - RNA, 64 nt, Human
uuauguuuguuucugcugcugugaaaccccaaaguaaugcaguagguuuuaauugaaaauuguu

SEQ ID NO: 8448 - RNA, 61 nt, Human
uuauuaaaacaaaaggguguauaguguucacaaacugugaaaauaguguaagaacuguaca

SEQ ID NO: 8449 - RNA, 63 nt, Human
uuauuaaaauauccagugagcucuuuagaaggacucaguauuauuucaagacuauuuuugagg

SEQ ID NO: 8450 - RNA, 62 nt, Human
uuauuaacccuuucagacccagucuguuggagccaugaaggaagagggaaagagggcugcca

SEQ ID NO: 8451 - RNA, 62 nt, Human
uuauuaacuagguaugaaguauaaacccauuuuggugcaauauucuugacuccuuggugcua

SEQ ID NO: 8452 - RNA, 62 nt, Human
uuauuacucaguggccagcucacuuagggcugagaugaaggagagggcuacuugaagcuacu

SEQ ID NO: 8453 - RNA, 61 nt, Human
uuauuacuuaacucuguggggcauuguuuagauacugugaagaguugagguaaauaugugu

SEQ ID NO: 8454 - RNA, 62 nt, Human
uuauuagguguucccuaauuuuuaccguaauaggucaucucagcuuauaugaaagucaagug

SEQ ID NO: 8455 - RNA, 62 nt, Human
uuauucaaaguguuagccuguuuuucuaccaacaauaagcuagaaaagacaaaaaaaacaaa

SEQ ID NO: 8456 - RNA, 62 nt, Human
uuauucagaugacugcagaaccuggaaaagcuguugcugcuauugaugcauaacauacugcu

SEQ ID NO: 8457 - RNA, 64 nt, Human
uuauucauuguuaaugcuuugaugaaaaggcuuuauaugcaguagaucuacgaaaauauuguuc

SEQ ID NO: 8458 - RNA, 62 nt, Human
uuauucauuucuguaaauuccuauguagaaggcucaguguuagaaauaaaguuauucuacua

SEQ ID NO: 8459 - RNA, 62 nt, Human
uuauuccugccuuuaauauggggaggaagguuccauaagcuacauguuuccuaguuaagcuc

SEQ ID NO: 8460 - RNA, 62 nt, Human
uuauuccuuuuuguuguuggccuugugcugcguuuguuuacaaaagauguauuuuguuuaac

SEQ ID NO: 8461 - RNA, 64 nt, Human
uuauucgcugauguaaacgguucgagugaagaauuaaugcaguaaguaugacaacacauacaca

SEQ ID NO: 8462 - RNA, 62 nt, Human
uuauucucauuuucucugaguuggaaacaaaaacaugaaggacuccaacuagaagacagaua

SEQ ID NO: 8463 - RNA, 62 nt, Human
uuauugacaaguuaaaauagcacucucaguuuuucaguauuacagagagcaaauaguuuccu

SEQ ID NO: 8464 - RNA, 62 nt, Human
uuauuguagaacuaaacuuagcauaguguucuguuguuuacaugaaguguguuuuucuuugg

SEQ ID NO: 8465 - RNA, 62 nt, Human
uuauuguccauauaccagauuuaaaauauuaauuugcugcuaauuaaauaauaguacugcag

SEQ ID NO: 8466 - RNA, 62 nt, Human
uuauugucccuggcuuccuuacuaugguguaaucaugaaggagugaaacaucauagaaacug

SEQ ID NO: 8467 - RNA, 62 nt, Human
uuauuuaaugagaauacuuuacauugcucacaugugcugcuaugaagacaggauuagucugu

SEQ ID NO: 8468 - RNA, 62 nt, Human
uuauuuaauuccuuaauuuggaaagcaguuuuaauguuuacaguuuaagauacucauuuuca

SEQ ID NO: 8469 - RNA, 64 nt, Human
uuauuucucccugauguuacaguuugguagauuucaaacuggaauagcuagcaugugcuugcua

SEQ ID NO: 8470 - RNA, 62 nt, Human
uuauuucuguguaugucaugagaaggcuaaauaucaguguuaauuucuuguuugaauccgug

SEQ ID NO: 8471 - RNA, 63 nt, Human
uuauuuuaaguauaugcauuuuuucugauuguugugugacuuaauucaguugcuggugugaac

SEQ ID NO: 8472 - RNA, 62 nt, Human
uuauuuuaaucauuuuaguaaugcucagcuggaccaguguuaguuauauuugagucagaaaa

SEQ ID NO: 8473 - RNA, 62 nt, Human
uuauuuuauaacugauuuuuaaaaugcuguuuuucaguauuaacuauguugaccuuagaaaa

SEQ ID NO: 8474 - RNA, 62 nt, Human
uuauuuuccaaaggauuuuguaucuuuuugaaaauguuuacaucaucagaugauccacagaa

SEQ ID NO: 8475 - RNA, 62 nt, Human
uuauuuucuguacuuuuuuguucauuaauuuugucaguauuacaccaaacuguuuuugcaac

SEQ ID NO: 8476 - RNA, 62 nt, Human
uuauuuugagauuugagauuuaaauuuuauguauuguuuacagucagaguaaaucacuggau

SEQ ID NO: 8477 - RNA, 62 nt, Human
uuauuuugauuuuagcauuaaaugucaucucaggacaucucuaaaagggguuguuuaauucc

SEQ ID NO: 8478 - RNA, 64 nt, Human
uuauuuuuaucaaaacaaauauaauugguggggacuggccaguaauaauguguggcgucuuuaa

SEQ ID NO: 8479 - RNA, 61 nt, Human
uuauuuuugcugcuguucucaacaucaucauugccugcugaugugccacgaugcugcucca

SEQ ID NO: 8480 - RNA, 62 nt, Human
uucaaaacuauuuguucaaagaacccguuaguguuguuuacaggguuacaguuucucucaca

SEQ ID NO: 8481 - RNA, 64 nt, Human
uucaaagcauguuucuuucccucaccacaacagaacaugcaguacuaaagcaauauauuuguga

SEQ ID NO: 8482 - RNA, 62 nt, Human
uucaaaggcaucacuauuuuuaaauguuuacauauguuuacauguuugugugcaacugcuuc

SEQ ID NO: 8483 - RNA, 62 nt, Human
uucaaaguauauacagagccuguuuuaaaaaauacaguauuauuuaguaaaauuaucuguuc

SEQ ID NO: 8484 - RNA, 62 nt, Human
uucaaagugcugccaguugaaaagggaagcauuauguuuacaaaucuguuuugaaauguuug

SEQ ID NO: 8485 - RNA, 62 nt, Human
uucaacaucuguaaaaugggcauguuaacauugccuaccucauaggauuacugugagaauuu

SEQ ID NO: 8486 - RNA, 62 nt, Human
uucaacauggaaaugauccucauugauuaauacaucaucucacacuuucaugaguucuucca

SEQ ID NO: 8487 - RNA, 62 nt, Human
uucaaccugcuucccagguggcccugaugcaccccaguauuagaguuuauugcuaaaaggaa

SEQ ID NO: 8488 - RNA, 62 nt, Human
uucaaccuuuuagggugauaaauacauguauaauuguuuacauacuuaaaaggaaaaaguug

SEQ ID NO: 8489 - RNA, 64 nt, Human
uucaacuuggcuuuuugucuuuuaaauuuuuaaaaaaugcaguaguguguuagagacuagaaag

SEQ ID NO: 8490 - RNA, 62 nt, Human
uucaaggaaaccuugacuuauaccuagcugucauaugaaggaaaugcaaagaaacauauauu

SEQ ID NO: 8491 - RNA, 62 nt, Human
uucaauacauguauacaauguauaaugaucaaaucaguguuauuagcauauccaucaccucc

SEQ ID NO: 8492 - RNA, 64 nt, Human
uucaauuauaucauuuuaugaauugugcuuuucauaaugcaguacauuucaaaauuuuuagauu

SEQ ID NO: 8493 - RNA, 63 nt, Human
uucacaaauccagcuucaaauacauaggagaauucacacuggagaaaagccauagaaauguaa

SEQ ID NO: 8494 - RNA, 62 nt, Human
uucacaauuugcuguaacccuuaacuuaaauagccaguauuaucuugcccuuuugaacauuu

SEQ ID NO: 8495 - RNA, 64 nt, Human
uucacagaucuccaaaaccaggaauuguucuaguaaaacuggaaauuuguaugaguggggggag

SEQ ID NO: 8496 - RNA, 64 nt, Human
uucacauuuccaaacuaugugcauaaaauagaauaaaugcaguauagaacuaugcuaaccaaaa

SEQ ID NO: 8497 - RNA, 63 nt, Human
uucacucagccuuaaauguuauaauauuuuuggauaacgguuauuaauucuuugagaccuucg

SEQ ID NO: 8498 - RNA, 62 nt, Human
uucacucucuggcugcugggucugccgucgguccugcugcuaaccuggcaccagagccucug

SEQ ID NO: 8499 - RNA, 62 nt, Human
uucacuuugcuguuguagauagccagucaaccagcaguauuagugcuguuuucaaagauuua

SEQ ID NO: 8500 - RNA, 61 nt, Human
uucagagagauuuaguuuuacuuuaauggagugacugugaagugguugggauuuuuugcuu

SEQ ID NO: 8501 - RNA, 61 nt, Human
uucagaguuuccuuuccagacaccccuccccgcacugugaaguuccccugaccgcccuccu

SEQ ID NO: 8502 - RNA, 62 nt, Human
uucagcaaagcauccacuaggaaaccucauaggacaguguuagugguucacguucuaguguu

SEQ ID NO: 8503 - RNA, 61 nt, Human
uucagccagucguuuguaaggcgcucgucggcaccugcugaaacgcccccaccugacagcc

SEQ ID NO: 8504 - RNA, 62 nt, Human
uucagccgcuauugcaagaugcccaaggauugggugcugcuagaggguguggaaaagaccaa

SEQ ID NO: 8505 - RNA, 62 nt, Human
uucagccuuucugguuauguuacaccuagcugaauguuuacaaggucuggauccaucagccc

SEQ ID NO: 8506 - RNA, 61 nt, Human
uucagcuuucccuucucccaaccagccccugccacugugaagcugaguguugggaggcagu

SEQ ID NO: 8507 - RNA, 63 nt, Human
uucaggaaaucuuguaguuuauuguuguuauuuaacaguauuaaguggauuuuuguauauuuc

SEQ ID NO: 8508 - RNA, 61 nt, Human
uucagguaaaagagaaugaauguaugauugugaacugugaagagaaugaugcaggauccua

SEQ ID NO: 8509 - RNA, 63 nt, Human
uucagguucugugcucuuuuuggagucuuuaagcucaguauuagucuauugcagcuaucucgu

SEQ ID NO: 8510 - RNA, 63 nt, Human
uucaguguuccguuuacccuuuuuacugaaaguaagugacuuaaaaggauggaagaaaaacua

SEQ ID NO: 8511 - RNA, 63 nt, Human
uucaguuuuucucucagguguuugcugggaaauuaacacuggaacugacccuuuucuggcagu

SEQ ID NO: 8512 - RNA, 64 nt, Human
uucauaaguucacucaagaaaaaugcagcuguucugaacuggaauuuuucagcauucuuuagaa

SEQ ID NO: 8513 - RNA, 64 nt, Human
uucauaaucauauuuuucaguaaauauugcucagugaacuggaaaacuuuaauagaaaaauguc

SEQ ID NO: 8514 - RNA, 62 nt, Human
uucauagcaacauaaugugucccugaguagaggaugcugcuaugcgugaguucauggacaca

SEQ ID NO: 8515 - RNA, 62 nt, Human
uucauaguaacauuauacuucauagccagaaaguauaagcuaauacccaucaggcugggugu

SEQ ID NO: 8516 - RNA, 62 nt, Human
uucauauguucuuuccuuuacccgguugcaaagucuaccucaugcaaguauaggggaacagu

SEQ ID NO: 8517 - RNA, 62 nt, Human
uucaucaggaaaucccaaaguuuccaaagcuuuuuguuuacagaauaaaacuucaaauaaaa

SEQ ID NO: 8518 - RNA, 62 nt, Human
uucaucauggaaaugauucucauugacuaauacaucaucucacacuuucauguucuuccauu

SEQ ID NO: 8519 - RNA, 62 nt, Human
uucaucauggaaaugauucucauugacuaaugcaucaucucacacuuucaugaguucuucca

SEQ ID NO: 8520 - RNA, 62 nt, Human
uucaucuguuuaaugaguagaauguccgugaugccuaccucacaggguuguugugaggguca

SEQ ID NO: 8521 - RNA, 62 nt, Human
uucauggaaggccuacaauucgaaaagcugcacauguuuacagaagagcucuuacccuccau

SEQ ID NO: 8522 - RNA, 62 nt, Human
uucauuagagcaggcguucagcucacuguucuauucaucucaaggaauaaugggcuuagagc

SEQ ID NO: 8523 - RNA, 62 nt, Human
uucauuaguuuacgaaccacaaaauugcaaauaaauaagcuaugaacuuugauguacacuau

SEQ ID NO: 8524 - RNA, 64 nt, Human
uucauucguggcuguguccccaucugagggccugguaugcaguaagaucaauaaauacuugugg

SEQ ID NO: 8525 - RNA, 61 nt, Human
uucauuucccccauccugguuuaaguauaaagcacugugaaugaagguaguugucagguua

SEQ ID NO: 8526 - RNA, 62 nt, Human
uucauuuuuaacuugcuaccuacuuuuaaauaaauguuuacauuucuaaauagaaaaaauga

SEQ ID NO: 8527 - RNA, 62 nt, Human
uuccaaaacucugcucucaggcugaaaucuggcaucaucucagguucccuguccccagcacu

SEQ ID NO: 8528 - RNA, 62 nt, Human
uuccaaaagaaaauggcuacaugaaaaaucuguccaguguuaucauuuuucuuacaaaaaau

SEQ ID NO: 8529 - RNA, 62 nt, Human
uuccaagugacuccgugccuugagugugucugcguguuuacacccgucccucugcuggccgc

SEQ ID NO: 8530 - RNA, 62 nt, Human
uuccacguuucuauagcaaccacauuugacuaauuuccguuaguugaauaagagguauuaug

SEQ ID NO: 8531 - RNA, 64 nt, Human
uuccagaaguaccaggcuguagauuugauaagcuagaugcaguagaccgaaaccauccaaaacc

SEQ ID NO: 8532 - RNA, 62 nt, Human
uuccagauuaccaaucaauuaaucaacaaauagccaguauuaugcuguguauuucugucagg

SEQ ID NO: 8533 - RNA, 63 nt, Human
uuccaguaaaauaacagcaaugacaaugagaucgucaguauuauuuucacauuucccugagag

SEQ ID NO: 8534 - RNA, 62 nt, Human
uuccagucacauuggugccauucaggacuccagcuguuuacaggaaauauguacuuagcaga

SEQ ID NO: 8535 - RNA, 63 nt, Human
uuccaguggcugccaaccacagggagugccaguuaacacuggaaggauuaaggcaaggucccu

SEQ ID NO: 8536 - RNA, 63 nt, Human
uuccaguuauuagcaaacucagacgaauguaccgccaguauuaucagcagucaacaagcaccu

SEQ ID NO: 8537 - RNA, 62 nt, Human
uuccauggaguugugcaaagcuauggcuuccuuggugcaauauucuuaaaaccugcuuugca

SEQ ID NO: 8538 - RNA, 61 nt, Human
uucccagggaagagggcggagcagagcaaagucacugugaacccugggccaggcccuggcu

SEQ ID NO: 8539 - RNA, 62 nt, Human
uuccccacucuuucugauauauugccuuacagaccuaccucaaacacacuguuuccacccuc

SEQ ID NO: 8540 - RNA, 63 nt, Human
uuccccaggguuuaguccuggggcuggcacucguugugacuuacacagagcaaaauugugcua

SEQ ID NO: 8541 - RNA, 64 nt, Human
uucccccaagacagagcaggggugaacuguagcuugaugcaguaaucugggacaagacugguug

SEQ ID NO: 8542 - RNA, 61 nt, Human
uucccccagcccacaaaggcacccuggccuuggccugcugaaguguuaggaagaggguggg

SEQ ID NO: 8543 - RNA, 61 nt, Human
uuccccucuccacgugaugucggucccccaucgccugcugagucacuugucuguccaccca

SEQ ID NO: 8544 - RNA, 61 nt, Human
uucccuauuuuugugacuucaagaauaauaugcccugcugaauacaugccauuucacauuc

SEQ ID NO: 8545 - RNA, 61 nt, Human
uucccucaccucccaaccaucauuacaggaaagacugugaacuccugaguucagcuugauu

SEQ ID NO: 8546 - RNA, 61 nt, Human
uucccuggacugccggaaucccagcauuagcuuccugcugaauguaguauuuggcauucuc

SEQ ID NO: 8547 - RNA, 62 nt, Human
uucccuuaacucaaaccaugcaaguuacugcaguucaucucaugggaggggcugaaauacac

SEQ ID NO: 8548 - RNA, 64 nt, Human
uucccuuacaauauggacaguauuaauccuuccaagaugcaguauuuaucaagugaagcauauu

SEQ ID NO: 8549 - RNA, 61 nt, Human
uucccuuagauaauucaaauuucuccacuugcuugagauuauaucauuucuuuuucaauua

SEQ ID NO: 8550 - RNA, 63 nt, Human
uucccuucuacaaggacuccauuggaucugcaagaacacuggaccuuuggguucuuucugggg

SEQ ID NO: 8551 - RNA, 61 nt, Human
uucccuucuguuucuuacaugggaucaaauacuugagauuaguacuucagaguacuggccu

SEQ ID NO: 8552 - RNA, 62 nt, Human
uucccuuugaaauaacgcuugccacaaguauauaauaagcuauauuaauuguguuuugcaua

SEQ ID NO: 8553 - RNA, 62 nt, Human
uuccgcccggaggaaugaacaagugucagucgaguguuuacagauccggccaggaccccggc

SEQ ID NO: 8554 - RNA, 61 nt, Human
uuccguuugauggacagcugucagcuuucucaaacugugaagaugacccaaaguuuccaac

SEQ ID NO: 8555 - RNA, 62 nt, Human
uuccuauguuagcuguuaaagaaacagcaggacuuguuuacaaagaugucuucauucccaag

SEQ ID NO: 8556 - RNA, 62 nt, Human
uuccucaacuguauaaugagguuacuacuaguaucuaccucaaagcguugucauguggauug

SEQ ID NO: 8557 - RNA, 62 nt, Human
uuccucaucuguaaaauggggcuaacaauauuaccuaccucauaggauuuaaugaugucaag

SEQ ID NO: 8558 - RNA, 62 nt, Human
uuccucaucuguaaaguggggauagugguacggccuaccucauaggguuguaaugagcacua

SEQ ID NO: 8559 - RNA, 62 nt, Human
uuccucaucuguaaaugaagaaaguaggcccugucuaccucacaugcaggucuagggugagg

SEQ ID NO: 8560 - RNA, 64 nt, Human
uuccucuaccugaacaaagagaugaauaauuccaugggccaguaugccaguuugaauucucagu

SEQ ID NO: 8561 - RNA, 61 nt, Human
uuccugaguggcucuggugauacucuccagccaccugcugacauucagaaucucagaccuc

SEQ ID NO: 8562 - RNA, 62 nt, Human
uuccugaguucuuccucucaaaauuucugugcaccaguauuauuccucauuuuacauacagg

SEQ ID NO: 8563 - RNA, 61 nt, Human
uuccugaucaugucuuuauuucaaugagaaagcacugugaaauugugaaagauucuccucu

SEQ ID NO: 8564 - RNA, 62 nt, Human
uuccugaucugcaaaauugguuuaauaauaaugccuaccucacaggguuguugugaggauuu

SEQ ID NO: 8565 - RNA, 62 nt, Human
uuccuguaguaggcuugcuggagcaaaggaaaugugcugcuaaaaaucaacuuaugccauuu

SEQ ID NO: 8566 - RNA, 61 nt, Human
uuccugugagacaggagaggcugagccaagggaacugugaaggggaugggcaggagggcuu

SEQ ID NO: 8567 - RNA, 63 nt, Human
uuccuucacuuccuuucgauaucaugaaaggacucacacuggagagaaccccuaugaguguaa

SEQ ID NO: 8568 - RNA, 61 nt, Human
uuccuucugucuuuaccugcuucguauccuuucccugcugauguggcugaccccucuccca

SEQ ID NO: 8569 - RNA, 62 nt, Human
uuccuucuguuaaaauggggauaauaauacugaccuaccucaaagggcaguuuugaggcaug

SEQ ID NO: 8570 - RNA, 62 nt, Human
uuccuugccccuguccaacccuggacaguuggcucuaccucaguaacacuuuauagcaaaau

SEQ ID NO: 8571 - RNA, 61 nt, Human
uuccuuucaaagaaaucucuuguaaauuacaaaacugugaauuggguugccaaaaacuguu

SEQ ID NO: 8572 - RNA, 63 nt, Human
uuccuuuccucugucuucaagcaccacgcagaaauacacuggauguucucucuuugcuucaau

SEQ ID NO: 8573 - RNA, 62 nt, Human
uuccuuucucuguuucagccuaugacaaaauugauguuuacaggccugcuuuuugcuuauaa

SEQ ID NO: 8574 - RNA, 62 nt, Human
uuccuuuuuuuuuuuuuuauuucgguuguuugaugugcaauauguuuuuguaugcagguagu

SEQ ID NO: 8575 - RNA, 62 nt, Human
uucgaaaugagcucaaauugauuuuuuaauuucuaugaaggauccaucuuuguauauuuaca

SEQ ID NO: 8576 - RNA, 62 nt, Human
uucgauacagcaaaguuuacgacacugggacugauguuuacaucuuuggaaagacaagcauc

SEQ ID NO: 8577 - RNA, 63 nt, Human
uucgaugguuucuucuauacaccuuuuugguugaccaguauuacuauacaauguaaguguuuu

SEQ ID NO: 8578 - RNA, 62 nt, Human
uucggggaaggcacuuggugauauaacuuuguuuuguuuacagaguaccugcucgggccagg

SEQ ID NO: 8579 - RNA, 61 nt, Human
uucgugauacagauuccuuugcucacauguuucccugcugaccuucuucccaccuguugcc

SEQ ID NO: 8580 - RNA, 62 nt, Human
uucguggaauuuaucacauccuguuguaacgcucuguuuacaucucugcugcccagccagac

SEQ ID NO: 8581 - RNA, 61 nt, Human
uucguggcgacuuagaguuggcggauauucggaacugugaauguacauagcguugaguuaa

SEQ ID NO: 8582 - RNA, 63 nt, Human
uucuaaaaaggugaaacuuuggcuguugaaaguuucaguauuaguaaacuugaguuacuuuuu

SEQ ID NO: 8583 - RNA, 63 nt, Human
uucuaaagugcucuuaugagagacuugugggccaucaguauuagugauuucauacugcagugc

SEQ ID NO: 8584 - RNA, 61 nt, Human
uucuacuccagccuggcaggcaaggcuaaaaccugagauuaucgaucuaugagacaucuug

SEQ ID NO: 8585 - RNA, 62 nt, Human
uucuagucccacuugucaaacagagcauucugaguguuuacaggcggaccuguucucuuccg

SEQ ID NO: 8586 - RNA, 62 nt, Human
uucuaucauagacaccauaggggaaaguuuggggaugaaggagagcuuaaagguguuucaau

SEQ ID NO: 8587 - RNA, 62 nt, Human
uucuaucuugaauuucaugcuuuccuaaagucucugcugcuaaggcucuauuuccuccccca

SEQ ID NO: 8588 - RNA, 62 nt, Human
uucuauucgaggauuuuauaauggcauauuuuuucaguauuaaagcgaaaauguuuucaacu

SEQ ID NO: 8589 - RNA, 64 nt, Human
uucuauugggacaguccucuucuauauguuuuaaguggccaguaauuuaaugaauuucugguuu

SEQ ID NO: 8590 - RNA, 62 nt, Human
uucuauuuaagaaagcuaguggacaaucaguguauguuuacaauuguuuauacacuguucuc

SEQ ID NO: 8591 - RNA, 64 nt, Human
uucucagugccccagaggucuaggauaggauuucuaaacuggaaucauccuuaaucaccuugaa

SEQ ID NO: 8592 - RNA, 61 nt, Human
uucucaugaccucugcugauccuccucuccucuccugcugagccuuccaccucugaccucu

SEQ ID NO: 8593 - RNA, 62 nt, Human
uucucauugaaaugcuuucccuuuuguauauagccaguguuaaauccuuaaaugcaauacag

SEQ ID NO: 8594 - RNA, 62 nt, Human
uucucccugcucaugaggucgcaccuuuugcucuugcugcuaauugcccauucguagugggu

SEQ ID NO: 8595 - RNA, 63 nt, Human
uucucccuuccacuucccuaagucucucuucagcugugacuuauccaccacauagcccaguaa

SEQ ID NO: 8596 - RNA, 62 nt, Human
uucucccuugaguccccaugcuuugucucccuccugcugcuauugcccggugaaugggaugg

SEQ ID NO: 8597 - RNA, 62 nt, Human
uucucuacucuuuaguagaguucgagacacagaagugcaauaacugcccuaauuaagcaacu

SEQ ID NO: 8598 - RNA, 64 nt, Human
uucucuagcaacaucauuuucagacuaacuaaaugaaugcaguauacucuuuucuuuguucuca

SEQ ID NO: 8599 - RNA, 62 nt, Human
uucucuagcauaauuuguauugaaaugaaaccaccaguguuaucaacuugaauguaaaugua

SEQ ID NO: 8600 - RNA, 63 nt, Human
uucucugaagaguauuuucgaagaggagcaacugaacacuggaggaaaagaaaaugacacuuu

SEQ ID NO: 8601 - RNA, 63 nt, Human
uucucuggcuuguuuuuuuguuuuucccagaaaaucaguauuauuuuuuaaauaagaaaaaca

SEQ ID NO: 8602 - RNA, 62 nt, Human
uucucuuguggcacuuaucacacuguauuuuacuuguuuacauguuugucuccccuucuaga

SEQ ID NO: 8603 - RNA, 62 nt, Human
uucucuuuuaaggaaauaccccuaaugugccaccugcugcuaucaccacaaauuaaacucaa

SEQ ID NO: 8604 - RNA, 61 nt, Human
uucucuuuuuaaucaaccagauuaaauaugaugugagauuauaauaagaauuauacuauuu

SEQ ID NO: 8605 - RNA, 61 nt, Human
uucugaacuguacauucacaacuuauguuucuuugagauuaauagauauugggggaaaaac

SEQ ID NO: 8606 - RNA, 62 nt, Human
uucugaagaagacaucugacccuagcagguuggccaguguuauugaacaacaaaaaugggau

SEQ ID NO: 8607 - RNA, 61 nt, Human
uucugacucaagugaaaacgcucagaauuucacacugugaauccacguuuacaacccuuac

SEQ ID NO: 8608 - RNA, 64 nt, Human
uucugagaaaccuggcagccugcuguuaacaacacaggccaguauuggguuuuauugaauuugg

SEQ ID NO: 8609 - RNA, 63 nt, Human
uucugagauugucagcccuuugucuaaaauaauggcaguauuaaugauugacuucugucacug

SEQ ID NO: 8610 - RNA, 64 nt, Human
uucugauaucccauuuuggugugucauaauacuucaaacuggaaagucaccuggucgagucuag

SEQ ID NO: 8611 - RNA, 63 nt, Human
uucugccaagucauuucaaauacaugaaaaaucuuacacuggagagaaacccuaugaguguaa

SEQ ID NO: 8612 - RNA, 63 nt, Human
uucugccaagucauuucaaauaccugaaaaaucuuacacuggagagaaacccuaugaguguaa

SEQ ID NO: 8613 - RNA, 63 nt, Human
uucugccaagucauuucgaagacaugaaaaaacucacacuggagagaaacccuauaaaugcau

SEQ ID NO: 8614 - RNA, 63 nt, Human
uucugccaaguuauuucaaacacaugaaaaaauucacacuggagagaaacccuauaaaugcaa

SEQ ID NO: 8615 - RNA, 62 nt, Human
uucugccagcaugcaccagugcagccuuaccaguuguuuacauccagcaucuguucugauug

SEQ ID NO: 8616 - RNA, 61 nt, Human
uucugccucugccacuacugcugccacaugggaacugugaagaggcacccuggcaagcagc

SEQ ID NO: 8617 - RNA, 62 nt, Human
uucugccuugaggaauuaugucaacacucauacuucaucucauucucccuucugcccugcag

SEQ ID NO: 8618 - RNA, 61 nt, Human
uucugcugaaaugguaguuucuugccagcaaggugagauuauggaauccagaaucuuuuuu

SEQ ID NO: 8619 - RNA, 62 nt, Human
uucugguuuuaauuuuuaguugugcuuugagucagugcaauaaacuagacuuuuuccaaacc

SEQ ID NO: 8620 - RNA, 64 nt, Human
uucuguaauuuuuugcccaccugccuugauuuaaccaugcaguauucagggucugggaauaugg

SEQ ID NO: 8621 - RNA, 64 nt, Human
uucuguacagguuuuuaaaacgugaaguaauguuugaacuggaagaugagcucaccaggcaaag

SEQ ID NO: 8622 - RNA, 62 nt, Human
uucuguaggaagaaucaaaucaccgauuuaaagagugcaauauauaauaaucauuuuuaaag

SEQ ID NO: 8623 - RNA, 61 nt, Human
uucugucaccuguucaguguggucugccccaccccugcugaccaagacugacugaaaugua

SEQ ID NO: 8624 - RNA, 62 nt, Human
uucuguccaacuccuaucccagccccuggggagccuaccucaggucugagagucugggugug

SEQ ID NO: 8625 - RNA, 62 nt, Human
uucugugacucucuuggaaaugccuugacugaaugugcaauauuugugucucuugguuucua

SEQ ID NO: 8626 - RNA, 62 nt, Human
uucuguuuaaacugugauuuucuuuauuguguuggugcaauauuuuauuaucauuuaaccuc

SEQ ID NO: 8627 - RNA, 62 nt, Human
uucuuaaaaguauauuuuuucuauaaacauccuuugcugcuacauuagaacuuuuauagccu

SEQ ID NO: 8628 - RNA, 62 nt, Human
uucuuaaccaucagagcagaggaggaaagacucacuaccucagaaaaaucucaaagaauagu

SEQ ID NO: 8629 - RNA, 62 nt, Human
uucuuaacuuauggugauacaguuauuugcauaagugcaauaagaaucuguucuaauuugua

SEQ ID NO: 8630 - RNA, 61 nt, Human
uucuuaaguggccaaauaacagauuagguaaaaugagauuacaugaaaagguucuaaaaug

SEQ ID NO: 8631 - RNA, 63 nt, Human
uucuuaauagguucaaaagcaaucuggucugaauaacacuggauuuguuucugugaucucuga

SEQ ID NO: 8632 - RNA, 62 nt, Human
uucuuccaaagcaauuucuuaaccaucagccaugugcugcuauuucuagggcuucugggcuu

SEQ ID NO: 8633 - RNA, 63 nt, Human
uucuuccuugugaacaugaaccauauaaagugucugugacuuaaugauuucauguaagucugu

SEQ ID NO: 8634 - RNA, 63 nt, Human
uucuucuaguucccuucaauaucaugaaaggacucacacuggagagaagcccuaugaauauaa

SEQ ID NO: 8635 - RNA, 62 nt, Human
uucuucuggacagaccacaacucuaagaagcuagugcugcuaucucauauaugaguauuaaa

SEQ ID NO: 8636 - RNA, 61 nt, Human
uucuucuuuucccucuuuaguauguaggucccaugagauuaaggcaaggguuggcagauua

SEQ ID NO: 8637 - RNA, 62 nt, Human
uucuugaaugcuuugucaaauuaagaaaguuaaagugcaauaauguuugaagacaauaagug

SEQ ID NO: 8638 - RNA, 62 nt, Human
uucuugagcaaucgcucgguccguggacaauaaacaguauuaucaaagaggccuccaacgcc

SEQ ID NO: 8639 - RNA, 62 nt, Human
uucuuuacacuuguacaauuauguaguaaauguauguuuacaggguuuaucauguuuacaga

SEQ ID NO: 8640 - RNA, 63 nt, Human
uucuuucacuucuuuucgauaacaugaaaggacucacacuggagagaaacccuaugaguguaa

SEQ ID NO: 8641 - RNA, 62 nt, Human
uucuuucuuucuuucugccaacuuuguuuuccaguguuuacaaggugacaaauguuugacuu

SEQ ID NO: 8642 - RNA, 62 nt, Human
uucuuugaaaauucuggcagaccaagguucuuuuuguuuacauaauacuugaaaaauaaaaa

SEQ ID NO: 8643 - RNA, 62 nt, Human
uucuuuggauuucuggaagguuaugacacuuuacuguuuacagcuaaugcauaguuacuugc

SEQ ID NO: 8644 - RNA, 62 nt, Human
uucuuuggcuuuuuuggacuauuuguggauacuuuguuuacauuuugaauauuaaaaugugc

SEQ ID NO: 8645 - RNA, 61 nt, Human
uucuuuuaucugaaugaaaauggugguacuaagacugugaaaauuaugugaaaccuaaagu

SEQ ID NO: 8646 - RNA, 64 nt, Human
uucuuuuccaaauaagcaucagauuuaucgccuauuaugcaguaacagucaauaaaauguacuu

SEQ ID NO: 8647 - RNA, 62 nt, Human
uucuuuucuccuuaucugugcagaacagguugcuuguuuacaacugaagaucaugcuauauu

SEQ ID NO: 8648 - RNA, 62 nt, Human
uucuuuuggcccuccgcccccgcaggcuucugugugcugcuaacuguauuuauugugaugcc

SEQ ID NO: 8649 - RNA, 62 nt, Human
uucuuuuggucccagagaggcagccugggcagucuguuuacagcuggcaaacagacuggcug

SEQ ID NO: 8650 - RNA, 62 nt, Human
uugaaaaagauucagugguucagcuuugucagcaucaucucaacacaagccugcuggcucuu

SEQ ID NO: 8651 - RNA, 62 nt, Human
uugaaaaucaaggagaaguuuaugcaacugaaaauguuuacacacugugcugcaaucuacug

SEQ ID NO: 8652 - RNA, 62 nt, Human
uugaaaaucaaggagaaguuuaugcaacuuaaaauguuuacacacuguggugcaaucuacug

SEQ ID NO: 8653 - RNA, 62 nt, Human
uugaaaauccuccaaaaaaaggagcaaagaaugcauaagcuauguguuggcaaaaguaauuu

SEQ ID NO: 8654 - RNA, 62 nt, Human
uugaaagcaaacuucacaauaauggacguagacuugcugcuaugaaaacauauuuuuuuuau

SEQ ID NO: 8655 - RNA, 62 nt, Human
uugaaaucugggcuguagugcuccugcuuuauuucuaccucaguuuuguuacauuucucuug

SEQ ID NO: 8656 - RNA, 61 nt, Human
uugaaaugcuuagaauuuuaaaccugaagagacacugugaauucuuuuguuuggaagaagu

SEQ ID NO: 8657 - RNA, 62 nt, Human
uugaaauguccagccuuugcccaauuguuucagaucaucucaugccucaggcuuuggcaggu

SEQ ID NO: 8658 - RNA, 62 nt, Human
uugaacacaaaggagggggcccaagcucgaacuucaguguuauuucaguuagagauacucuu

SEQ ID NO: 8659 - RNA, 61 nt, Human
uugaacuccuccugccuuggccucccaaaaugcugagauuacaggugugagccacugcacc

SEQ ID NO: 8660 - RNA, 62 nt, Human
uugaagagaaucccaaaaguuaguucaucuuaaagugcaauauuguuuaaucuuaaaacugg

SEQ ID NO: 8661 - RNA, 61 nt, Human
uugaagcuaucucaguaaaaagcagcuuuggaaacugugaaugaucuuuagcuuguacaaa

The invention claimed is:

1. An isolated nucleic acid that is from 18 to 100 nucleotides in length comprising a sequence selected from the group consisting of:
   (a) the first 22 contiguous nucleotides of SEQ ID NO: 46;
   (b) a DNA encoding the sequence of (a), wherein the DNA is identical in length to the sequence of (a);
   (c) the complement of (a) or (b), wherein the complement is identical in length to the sequence of (a) or (b); and
   (d) a sequence at least 80% identical to the sequence of (a), (b), or (c).

2. The nucleic acid of claim 1 wherein the nucleic acid comprises a modified base.

3. A probe comprising a human insert, wherein the human insert consists of the nucleic acid of claim 1, wherein the probe comprises no other insert.

4. The probe of claim 3, wherein the nucleic acid is a miRNA.

5. A vector comprising a human insert, wherein the human insert consists of the nucleic acid of claim 1, wherein the vector comprises no other insert.

6. The vector of claim 5, wherein the nucleic acid is a miRNA.

* * * * *